United States Patent 12,577,609 (METHODS FOR CELL-TYPE SPECIFIC PROFILING TO IDENTIFY DRUG TARGETS) - sequence listing, part 16

SEQ ID NO: 21708 - DNA, 1860 bp, Homo sapiens
  ENST00000264771
acttcctggctgcgcgcgcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 21709 - DNA, 2084 bp, Homo sapiens
  ENST00000513952
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 21710 - DNA, 683 bp, Homo sapiens
  ENST00000514453
gacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggc

SEQ ID NO: 21711 - DNA, 990 bp, Homo sapiens
  ENST00000505734
gcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatccttgggtcccccagctcctcaggcagcttaggggggcccagcactgccctcgagtccccagtactgccacacccaatccaacaagcgtctcttgctctcctgcttccttctgtctctttgccccctcagatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactccca

SEQ ID NO: 21712 - DNA, 784 bp, Homo sapiens
  ENST00000515492
tcgccgggcttgcgatgaacttccggctgtcaagctcccggccgggctgactcaagcggaggcgcgcggaacagtcgccgaggcgattcccgcccagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagagg

SEQ ID NO: 21713 - DNA, 776 bp, Homo sapiens
  ENST00000504744
gccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgcca

SEQ ID NO: 21714 - DNA, 621 bp, Homo sapiens
  ENST00000509508
gaacttccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactc

SEQ ID NO: 21715 - DNA, 2011 bp, Homo sapiens
  ENST00000452360
gaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgtgccccccatcgcttcgcagcccctcctgctccctttggctggctgttgcttccttccagcgtctgctcctccgcggcctcatctgcctcttcgtctgttagagcgcgcgtctcgtctcagtcgtcacgtttttggtttttgtggggtttttttttttttttttttgagacagtcctgctgtgtcgcccaggctggagtatagtggctcaagctcagctcactgcaacctccgcctcccaggttcaagcaattctcctgcctcagcctcccaagtagttgggattacaagcacccaccaccatgcccagctaactttttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctcgagtccaagtctcctgat

SEQ ID NO: 21716 - DNA, 1007 bp, Homo sapiens
  ENST00000515876
aacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctggtgaggaccccgcgtcacctgccccagctatcaggtggccaatgtgtcttgagt

SEQ ID NO: 21717 - DNA, 581 bp, Homo sapiens
  ENST00000513682
acttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttc

SEQ ID NO: 21718 - DNA, 1514 bp, Homo sapiens
  ENST00000515740
tccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagt

SEQ ID NO: 21719 - DNA, 2236 bp, Homo sapiens
  ENST00000438836
gtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 21720 - DNA, 583 bp, Homo sapiens
  ENST00000504505
aagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatccttgggtcccccagctcctcaggcagcttaggggggcccagcactgccctcgagtccccagtactgccacacccaatccaacaagcgtctcttgctctcctgcttccttctgtctctttgccccctcagatcctgcctgtgacccacacggagatctccccagaacagcagttcgacagaagtgtacagaggcttctggcaacacggattgccgtctacctgatgacctttctcatcgt

SEQ ID NO: 21721 - DNA, 1399 bp, Homo sapiens
  ENST00000508204
ctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcc

SEQ ID NO: 21722 - DNA, 1006 bp, Homo sapiens
  ENST00000510493
cccggccgggctgactcaagcggaggcgcgcggaacagtcgccgaggcgattcccgcccagatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcc

SEQ ID NO: 21723 - DNA, 619 bp, Homo sapiens
  ENST00000514546
cggccgggctgactcaagcggaggcgcgcggaacagtcgccgaggcgattcccgcccagctcccctgccctgagacagcctccggtgcttctgctgtgtcccaggaaacaagcctgaagcaagcactcaccatccctcaagaatgtgccctgacctaccttcctcaccacggtggcatcagggccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccc

SEQ ID NO: 21724 - DNA, 984 bp, Homo sapiens
  ENST00000504850
gggctgactcaagcggaggcgcgcggaacagtcgccgaggcgattcccgcccagctcccctgccctgagacagcctccggtgcttctgctgtgtcccaggaaacaagcctgaagcaagcactcaccatccctcaagaatgtgccctgacctaccttcctcaccacggtggcatcagggccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatccttgggtcccccagctcctcaggcagcttaggggggcccagcactgccctcgagtccccagtactgccacacccaatccaacaagcgtctcttgctctcctgcttccttctgtctctttgccccctcagatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcag

SEQ ID NO: 21725 - DNA, 673 bp, Homo sapiens
  ENST00000504180
tggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttg

SEQ ID NO: 21726 - DNA, 412 bp, Homo sapiens
  ENST00000502513
gcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacggtgagcaacaccaggcccctgacaccctgaggctttgctgggcaccactggatttgacctgtcctcaaaagcagaccagctggatggcccagggcccaggccacacggttgtagagaagagagaaggttctggggagagccagctgttgggctgttgggggcttctttcaggctggcggggaggggaggcagtggccccgatgagggagtcaccggcgctcccagctcccacccggccctgagcccacagccccct

SEQ ID NO: 21727 - DNA, 292 bp, Homo sapiens
  ENST00000506669
cttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggtaggtga

SEQ ID NO: 21728 - DNA, 1967 bp, Homo sapiens
  ENST00000622959
gtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcct

SEQ ID NO: 21729 - DNA, 1530 bp, Homo sapiens
  ENST00000484928
ggccccgcccaggctgcgcggtttcccgaaaccagctgcggcccgggggcccggcaaagggggttccgcccggaggagcggaccgggcgggagaagaccgagcccccgcgcgccccctgcgctcccactcgcgcacacttgcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgtta

SEQ ID NO: 21730 - DNA, 1261 bp, Homo sapiens
  ENST00000004103
gcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagg

SEQ ID NO: 21731 - DNA, 1504 bp, Homo sapiens
  ENST00000494349
cagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgagtgtgacggcctgcctcgtcgggcggcgggaggaactccccacctccagccgcagcagcactctctgccagcctccctctgaacaggacaccgagccagttatgtcttcttacttagcgatgtgattctctggccttctcagtaagagcctggggaggggaggctctgggctgaaggggtgtggaggagccactgaccatgcagagtcccaatcagtggagccctgagtccatcctttcctctgggccaaactcaggatgggccggctctcctctccttcctttcccttctcttttctcctcctcctgcctcttcttctttctccttctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttccca

SEQ ID NO: 21732 - DNA, 925 bp, Homo sapiens
  ENST00000475710
gccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgagtgtgacggcctgcctcgtcgggcggcgggaggaactccccacctccagccgcagcagcactctctgccagcctccctctgaacaggacaccgagccagttatgtcttcttacttagcgatgtgattctctggccttctcagtaagagcctggggaggggaggctctgggctgaaggggtgtggaggagccactgaccatgcagagtcccaatcagtggagccctgagtccatcctttcctctgggccaaactcaggatgggccggctctcctctccttcctttcccttctcttttctcctcctcctgcctcttcttctttctccttctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctaggaggatttttctacatccgcgactacaccctcctc

SEQ ID NO: 21733 - DNA, 635 bp, Homo sapiens
  ENST00000461345
agactgtgtccctgacaatgggaacagccgacagtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaa

SEQ ID NO: 21734 - DNA, 827 bp, Homo sapiens
  ENST00000475536
ggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaaggggtgagtccctaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttccca

SEQ ID NO: 21735 - DNA, 469 bp, Homo sapiens
  ENST00000468689
gaggaactccccacctccagccgcagcagcactctctgccagcctccctctgaacaggacaccgagccagttatgtcttcttacttagcgatgtgattctctggccttctcagtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgt

SEQ ID NO: 21736 - DNA, 2065 bp, Homo sapiens
  ENST00000462826
ctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctaggaggatttttctacatccgcgactacaccctcctcgtcacctcgggagctgccatctggacaggggctgtggtgagtagagcaggacagtgcttgactgcctgtgagaggggtggggcattgctctcctgattgccttcctccaacatggcgccacagaatgctggcagtcggagagatctgattatctaggaccattccctgcctgttcagatgagcaaacagctgagggcggtggtggcatgtcctattcacactgtctgctctcccatacccttcccagtgctgttcccaccaggctggctgcctctccctgccttcaacagttaatgtcaactaaggatctaaggacctgctcatctccagatacttgcattgagatggggaaggcagagcgttccagatagtatgtggtcccccaggaagcatcaccccctggttattctcattgtcctccacaggccctgtacacaatggaaacccaggaattgttgtcaacagatgggtgtgtgcagtttgcacaggagctgggtaggctggtcatggtacctacactctcagaatagcactaaaacactcatatttactgacagaagccgagagtaattaccttcacccagcctgtggcaaaatacccagcttaattacagaattagccaaacaggattcaggtccacctgtccactgggacatactagatttcctgttcttcaagcccagctgagtggattattgggcactgttaggacaggcttctagacctaacagtgcccactctgtatagactcacccttcattgagatcttctccagcaccccatgacttttatccacaggatcccaccatccctagaactttcataaagcacttggtgttgtttaaaaaggaaggtttagaagggaagaggggctcacacctggcttgaccacaagctcttaggtgtcactaaagcagggccttttgcagcctcaggagttggatccaggctccaccctctcagcaattatcttaccatggataataaagcttagcatgaaacctcccgcccaagctgtgtgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggtaagttcagggaagggcatgggaggggaccaggttcaggctggaggtcaccccaatctcctgccctgttgcaggcttctctgggccttgcccttttttcccccgactggactctgagagagactgaaacacaaagatttctctctgcctcctccctccccaggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgtt

SEQ ID NO: 21737 - DNA, 862 bp, Homo sapiens
  ENST00000475007
gcctcaggagttggatccaggctccaccctctcagcaattatcttaccatggataataaagcttagcatgaaacctcccgcccaagctgtgtgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaaggggtgagtccctaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgt

SEQ ID NO: 21738 - DNA, 652 bp, Homo sapiens
  ENST00000481305
gctgtgtgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattg

SEQ ID NO: 21739 - DNA, 534 bp, Homo sapiens
  ENST00000474166
ggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaaggggtgagtccctaaggtgtgtgcctgtgtatttggggcagtggaactgctcaaaggagacaggaatggacagtggacagtttggggaggagaaaggggcccatgacccaagtcccacctattatcatgcctgtctttctacccagtggtggcccagcccagaaagcccctatccccaaccaagtggcccccaagtcaaagagcccaggaat

SEQ ID NO: 21740 - DNA, 1265 bp, Homo sapiens
  ENST00000492607
ctcggggtcagctagtgtccgctctgctcggccgcgggctcccggaggactgcaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaaga

SEQ ID NO: 21741 - DNA, 1129 bp, Homo sapiens
  ENST00000326442
gtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 21742 - DNA, 1430 bp, Homo sapiens
  ENST00000447204
gctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 21743 - DNA, 1206 bp, Homo sapiens
  ENST00000429904
cccacctcagcctcccaaagcactgggattacaggcgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagca

SEQ ID NO: 21744 - DNA, 1006 bp, Homo sapiens
  ENST00000450753
cccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagc

SEQ ID NO: 21745 - DNA, 1303 bp, Homo sapiens
  ENST00000434545
cgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggtgaggccaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgccc

SEQ ID NO: 21746 - DNA, 569 bp, Homo sapiens
  ENST00000437068
aacgaaaaaagaagtccatctcatagcaggttgaaatgaagtgggagaaaaatctctggtcatcgttctatcgctccactgacactcggtgtctttttctttcagaagaggggcttgagcagagagaatgcttagaggctaagcgatgggcaagtgagagggaaagagccgcgacagatagagctggctgcctaggggtctcagaggcttcatcctgcaggcggcaggcggcaggacaaagggaccttcggactccagatcaagattccaaggagttaaacgctaccacgcagcccgacctggatgggatttgctcctgggtacaaaacgggacactgatcaaaatcaacttggacaagtgacaagagtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctg

SEQ ID NO: 21747 - DNA, 836 bp, Homo sapiens
  ENST00000482239
gggaaagtgtgagaggaagagttggagaaaagtcgggggaaagtagggacagggttaaggggagagaggaggatgagggcggcgaggagagattaaaaggggaaggggggtcgctggagaggagggcggactgtggatcggaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgac

SEQ ID NO: 21748 - DNA, 1662 bp, Homo sapiens
  ENST00000281961
attgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaa

SEQ ID NO: 21749 - DNA, 571 bp, Homo sapiens
  ENST00000413011
agtttagaaggcgcaactgtggggatgggcccccttttccccactcatagagagatttctgtctggagatgtcagttccacttggtcaagaggaggttttcccttcccatcctcaccaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggacc

SEQ ID NO: 21750 - DNA, 515 bp, Homo sapiens
  ENST00000495402
ttacaagcacggaacagaggaggagatgggtcttgagtatatttgcagtgatttaaaagggaccacacatttccctagcacagaagctgttctaaggccagctcttgtgagtctgagaaaatagtttctccccacttcacaccctctctccagcattaagcagcttctgtgagatgcaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcc

SEQ ID NO: 21751 - DNA, 1286 bp, Homo sapiens
  ENST00000618232
gggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgccccc

SEQ ID NO: 21752 - DNA, 10558 bp, Homo sapiens
  ENST00000565468
cgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcactttcaatatcacgaagaccatccgtcaggatgagtggcatgccctacacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccatcactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattatgactgttgtctctcttatcactgtagtggtttcatggccccagatagaggcccagagacctagaaattgtcatgagggacaggcctataagggtgccaattctgcagctacagatccctggagtggtgtgtgtgtgcgtgtgtgtgtgtgtgtgtgtgtgtgtgtgtgtgtgtggtggatgtttcttgagcgtggggttttattgtttgtgttgtgtttttttaaattgtttctggtatagctgaaatttccagagggcagaaccaagaacaaagccactgggccagaggacccccgtggttctccacattacagctctgggactctgcacgatttagtcctctaattttggaagttcaagacacagctgggcacataagccatgagagaagagggggaacacacagttcaggagagagaagaaatgttgctctggttgctgttgtacaagaacataaaccaacaagaccttcactccccattatagaagctgtcctttgtcactggacatctcccctttccctaggggtgacctctgtacaaacgaaaggaagtgggtcacatgcagagagagcacctccatttcccatgggctcaagtttgtatgatattgtgtaaattaatgcagaactcttgactctttccatcctcttcctttccctcttgatattcaaggccatgaatcccaaaataacagtcttagtggctagcacccaaacagaggtggaataaatccaccccagtgtctcgggctcatttgagcaaattagcactgcaggtgctggcaagcaaagtcagccagagagttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctcacctactaaccacttaccttctctctcttctatcttccaccctcatctgctcctttgaactgcgtgtatgtaattcatatctggatatgatatgacatctgatgtgcatgaatggggttgaatgtggatctctctgtatgtgtatctctctggtgcattttgtgtacgtttgtgtcagtacacacctgcacacaggtgtgggtgccctactcaagacttccttaccggggactctggtcagcttctgcaaaaggtctcatgtgtgagttccctgtgtgtgggtgtgctgggcgatagggtaaggtgtgcaacgggaaaagttgttagcttccagttggggttctaaggattatttttaaaacaaaggatttattctatgagaagggaaataattttcaggaaaacccagtttttcaattgggcattttatttctaattttctttgaaaagttagatttctcccttaaggggaagggcatacttgggcttaaggaaaagtgaagaaaagtatctcagattgagaggccttttgtcttccttccaagcgtcctgaaggggctctgccgaggaagggacagacaggttcacaagcatccatttgggggagagggcttgtctatgaccacactgaaattccagcttttttccagttgcaggagagaggggaaaaattctaaatggggaaatttgctatgaaccatttaaactttttgtaagtaatcatgtttgaggatgctggctcacagacctatcattatttatatcctctttttaaaaaaaaatcccatactttcaatgaatagattatctgctctatccaattattgtctttgtgacagacatttagcaaagcttactgcatccctttgaaaccttgagagttcctgaaatgttagaaagctcccaggaaagacgtaaacaacctgggctcaactcaccagcccagagcaggggctttgagtgacttctttgatagcaggaccagataaatacgaacacactttgggatctgatcctgctgggaagcaaaagacgcccagccacatgaccaggatagaggcccctttcagacggcaagtcctggccaatgggaggacttctcaggtgaccttgatccctctagcataagggcttgaccacagattaaaacatgtgactccaaccagttacggaagctttctggctgtgaggtagctgagggagatgaggaggaggaagagaggagccttgacttgtgaggctctgtaggtcagactctgctaactccaaatcaaagtggaacccaaccttatgagggcatttagggtcaatgacctcactaaagtcaccagccgcaaccccaggtcaagttcaaacttcttactggcatatgaacatgtatgtgctttgagctccatgcaagtcaaccttgagcctggggcccattgcaacttttatttccttccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagacttccttttgtctagagccagttttgcaaagggcacttttatccatctcagttattcccagaggtgacagaatgagtaaaccatatggggcaaatagcatatatgagctaaaccagttaactgttaaccaaggcacatggtcaatgccttagtatttttttttttaattctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccattgattgaagaaaaacaagtgtctggtaattaattaaatgacttgttcatggaaaaaataaataatctgtcagttgtggaatgtaaactgattaaacaattaaataaagaagattatgttgtgtgttttaaa

SEQ ID NO: 21753 - DNA, 474 bp, Homo sapiens
  ENST00000563442
cggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcactttcaatatcacgaagaccatccgtcaggatgagtggcatgccctacgtaagtgcacctgagtctcagtggctgtgactgtgctgtgaggtcccctttggagggatt

SEQ ID NO: 21754 - DNA, 10552 bp, Homo sapiens
  ENST00000610315
cgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcacttttaacgtgaccaagactttgcgttgtatgtactgtatgtacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccatcactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattatgactgttgtctctcttatcactgtagtggtttcatggccccagatagaggcccagagacctagaaattgtcatgagggacaggcctataagggtgccaattctgcagctacagatccctggagtggtgtgtgtgtgcgtgtgtgtgtgtgtgtgtgtgtgtgtgtgtgtgtgtggtggatgtttcttgagcgtggggttttattgtttgtgttgtgtttttttaaattgtttctggtatagctgaaatttccagagggcagaaccaagaacaaagccactgggccagaggacccccgtggttctccacattacagctctgggactctgcacgatttagtcctctaattttggaagttcaagacacagctgggcacataagccatgagagaagagggggaacacacagttcaggagagagaagaaatgttgctctggttgctgttgtacaagaacataaaccaacaagaccttcactccccattatagaagctgtcctttgtcactggacatctcccctttccctaggggtgacctctgtacaaacgaaaggaagtgggtcacatgcagagagagcacctccatttcccatgggctcaagtttgtatgatattgtgtaaattaatgcagaactcttgactctttccatcctcttcctttccctcttgatattcaaggccatgaatcccaaaataacagtcttagtggctagcacccaaacagaggtggaataaatccaccccagtgtctcgggctcatttgagcaaattagcactgcaggtgctggcaagcaaagtcagccagagagttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctcacctactaaccacttaccttctctctcttctatcttccaccctcatctgctcctttgaactgcgtgtatgtaattcatatctggatatgatatgacatctgatgtgcatgaatggggttgaatgtggatctctctgtatgtgtatctctctggtgcattttgtgtacgtttgtgtcagtacacacctgcacacaggtgtgggtgccctactcaagacttccttaccggggactctggtcagcttctgcaaaaggtctcatgtgtgagttccctgtgtgtgggtgtgctgggcgatagggtaaggtgtgcaacgggaaaagttgttagcttccagttggggttctaaggattatttttaaaacaaaggatttattctatgagaagggaaataattttcaggaaaacccagtttttcaattgggcattttatttctaattttctttgaaaagttagatttctcccttaaggggaagggcatacttgggcttaaggaaaagtgaagaaaagtatctcagattgagaggccttttgtcttccttccaagcgtcctgaaggggctctgccgaggaagggacagacaggttcacaagcatccatttgggggagagggcttgtctatgaccacactgaaattccagcttttttccagttgcaggagagaggggaaaaattctaaatggggaaatttgctatgaaccatttaaactttttgtaagtaatcatgtttgaggatgctggctcacagacctatcattatttatatcctctttttaaaaaaaaatcccatactttcaatgaatagattatctgctctatccaattattgtctttgtgacagacatttagcaaagcttactgcatccctttgaaaccttgagagttcctgaaatgttagaaagctcccaggaaagacgtaaacaacctgggctcaactcaccagcccagagcaggggctttgagtgacttctttgatagcaggaccagataaatacgaacacactttgggatctgatcctgctgggaagcaaaagacgcccagccacatgaccaggatagaggcccctttcagacggcaagtcctggccaatgggaggacttctcaggtgaccttgatccctctagcataagggcttgaccacagattaaaacatgtgactccaaccagttacggaagctttctggctgtgaggtagctgagggagatgaggaggaggaagagaggagccttgacttgtgaggctctgtaggtcagactctgctaactccaaatcaaagtggaacccaaccttatgagggcatttagggtcaatgacctcactaaagtcaccagccgcaaccccaggtcaagttcaaacttcttactggcatatgaacatgtatgtgctttgagctccatgcaagtcaaccttgagcctggggcccattgcaacttttatttccttccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagacttccttttgtctagagccagttttgcaaagggcacttttatccatctcagttattcccagaggtgacagaatgagtaaaccatatggggcaaatagcatatatgagctaaaccagttaactgttaaccaaggcacatggtcaatgccttagtatttttttttttaattctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccattgattgaagaaaaacaagtgtctggtaattaattaaatgacttgttcatggaaaaaataaataatctgtcagttgtggaatgtaaactgattaaacaattaaataaagaagattatgttgtgtgttttaaa

SEQ ID NO: 21755 - DNA, 588 bp, Homo sapiens
  ENST00000415614
ctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagggttccctgattgactcacatggcgtggagactcctcccgggcagtcc

SEQ ID NO: 21756 - DNA, 815 bp, Homo sapiens
  ENST00000556320
gcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggggctctgcctgggccctggccacatgcagccctgcgtgtgtcccctcgacgccacgtgtagtgagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcccagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctta

SEQ ID NO: 21757 - DNA, 1430 bp, Homo sapiens
  ENST00000556573
aattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagtttggcctctgggcctcatggctggcctggctggccatcaccacgctggccttcctgaaggtctaccacaactaccgtcaggaggacctgctggacagcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggggctctgcctgggccctggccacatgcagccctgcgtgtgtcccctcgacgccacgtgtagtgaggtgagcgccccagtgcccacctgtgagcctggcagtggactgggtgggtgccggctccctgatgaggatggtgcagagagactatgggtgtggggcgggggcggggggcacctccaggcctcgcacagggccccttggctgtcccagtaggacctgactggccagcctatgtggagggcgtccagcttgtctcccccaaccctggccggatgctgtctccatgccagctggcccaggggtggccagatgtcacttagccctgaacgaattctgcatgaattctgccatccaggcagaggctgcgtgtggggaggagctcacggcaccttccagcctctgg

SEQ ID NO: 21758 - DNA, 2513 bp, Homo sapiens
  ENST00000341595
aataaaacaaaaatattttttaatgcttgcaacaaaaatgctgatggaattttaaaccaggaggagcaatgttaaggcttcctcactctgggaattggactaaaggtgacttagtcttaaaggcaactagaaaaggcattaattctattaattaatgcctcagcgatttccatctcagcaaagatgtcttaatgaggcgctcgggacacccattatttatcttacaaatgcagctccagggtcctgcccatgtcaggcagtgtaacacacgtccccgcggagggctggcgctgcagaagctcccggtccaccccctcctgcccacacctggcctcaccctccccatctcttcgaggatgacctctgtcccagtcccttggaccccgactcctccacgatctggcccctcccctcatacattgcatttcgggacccccgcaaaggaatcacttcagcctggactgcaaaccgcactcctacacctcactatgagcaccttgggggtgtcctccaacaccccccgccccgccctctctctcctggtctcctttcgttcgagctgatgaggaactgacgacccagagtcggcctgtgtgaggcccgtacaggtggctcccgaagtctttagcggcacagggtcggtccctccaggccgacctggtaaaattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtagggggctctgggcaagaagggaggcttgcaatgctgggagggggccatttactgctggacatttgctgagctctcccccatccagaggaggaggcaggctcctgtgtggataaggtagttagcaatgggaccaggcagtgggagcagtcgggaaggcttcctgcaggaggtgggggagagctgggcttttgtaggtgggtttggggaggagatggccacagtgagttagaatcaggaagtggcaaggccctggggtctggggtgggaagtgtgggggtgtggggggaggtggtgccagaaacgaaaccaggcatcagatcctgggggtccagtgtagggacaagggctttggactttggtgctggcgctgggtgggcctgttcagatcagagctggaggcttagaggagtcccctagccagggggaagctgatacagagtccaaggaaggaggcaggggatcccacttgtgaattcagatttgccaccctgcccttgtataagctgcgtcccccgccccctaggagacttggtggagggcgatggtggcccccactctgagggacgctatttgctgaaatgcaggcatgtggggacacatcagtggcccgtgagggccggagggggaaccctggaattgggtttgccccttgaaatctgcagatgtgccccagacggagatgaggcagatgaggggtgccgggtgggggtggctgagaccagacacctggctcctgccagcactgatcagggcccgctggcttcaggtccaattccggaccccaggctggcctctgaaggctcttgctggccgtggctggcctgaggacgcttctcctggccaggagccctccaagggtgctggacatgggtgggcctgaatgctctttgccgagatgaactggacctgtcaaagacaccttcatgcaaatttagtgagtggaagaggcctcaggcctaatttgtgccagttggattaaggtgtgagtgcagtctgatggcaaatacgctcaaatgagaatcagcttaatgtagctcaggcctggttctgattaaattgtttctccttcaactgtttggaaa

SEQ ID NO: 21759 - DNA, 636 bp, Homo sapiens
  ENST00000615704
atggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtccaattccggaccccaggctggcctctgaaggctcttgctggccgtggctggcctgaggacgcttctcctggccaggagccctccaagggtgctggacatgggtgggcctga

SEQ ID NO: 21760 - DNA, 1645 bp, Homo sapiens
  ENST00000616017
gtgagggtgtgactgagtgcatgagagtgtgactgcctgtgagtgaatgtgtgactgcatgtgcgagtgactgcctgggaggatgtgattgtgcatgagtgtgcatgtgggtgtgactgcatgtgagggtgtgactgttgtgcgtgtgaaggcttgattgtgagtgtgcctgggaggatgtgagtgtgagggtgtgactccctgtgacatgagtgtgcatgcatgtgagtgtgaggaagagtgtgtaggtgtgagtgtctaggcaggtgtgtctgcagtgtgtgcagcatgtgcgtaagtgcatgtgaatgtgcgtgtgttgcatgtgagcatgtgcacgcctgtgcgtgtgagcattgtgtgcgtgatgggagccgtgggtgctgtgtggacagcccctctgcccctcccatgggctcccacgcccagcatccacctgagagaggagggagctgccttcccattctgcagagtctgtgtgctgaggccccgcagaagcaagtggaggagctgggatgtgaacctgggaccccggcgtagggggctgcttggctgtggaccctgcccctcaggaaagcccagggtccacctccagaggactcgttctggggcgggggcggaggcggggggcctccccacccggggctcgatgaggggctgtccgtttcttggctcgagtgctgccaagtgctccctgctgctgcgcccaccttcccggggagaggcgagcccctggctccctgagttcatgacccaccctgtccaccatcagcagctggcttgtgtctctgggtggctgggcaccagcctcctggaggccacgtgcctgggtccacatggagggtcctggtgggggcatcatcctgggtcccgggagtgaggctggcaggtgcccatcgggggtgtcaagtccagggggatcgaggctctggaagctcaagggggctctggccttggggaccagctgagtttccagctggcagccaggtcctcgagggaaggggtttggacagaatccgaggccccctaagctgatggggtcccctgtctccccttccagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcccagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctt

SEQ ID NO: 21761 - DNA, 586 bp, Homo sapiens
  ENST00000615269
ctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagggttccctgattgactcacatggcgtggagactcctcccgggcagt

SEQ ID NO: 21762 - DNA, 815 bp, Homo sapiens; identical to SEQ ID NO: 21756
  ENST00000625459

SEQ ID NO: 21763 - DNA, 1430 bp, Homo sapiens; identical to SEQ ID NO: 21757
  ENST00000630378

SEQ ID NO: 21764 - DNA, 2513 bp, Homo sapiens; identical to SEQ ID NO: 21758
  ENST00000625335

SEQ ID NO: 21765 - DNA, 636 bp, Homo sapiens; identical to SEQ ID NO: 21759
  ENST00000621393

SEQ ID NO: 21766 - DNA, 1645 bp, Homo sapiens; identical to SEQ ID NO: 21760
  ENST00000620158

SEQ ID NO: 21767 - DNA, 4178 bp, Homo sapiens
  ENST00000296582
gagctgaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggacttttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccatagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaatgaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatat

SEQ ID NO: 21768 - DNA, 1528 bp, Homo sapiens
  ENST00000508208
ctgaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggccttaaccccgaaactgactatactggagaaggaaaggccgtgtaaagacacaacaagaaagcagaatctgcaatccaggaagagaatcctcacaagaaaccaaacttgccaacaccttgatcatggtcttccagcctccagaactgtgagaaaataaatgcctattgttaaagcta

SEQ ID NO: 21769 - DNA, 774 bp, Homo sapiens
  ENST00000505999
cttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttgcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaa

SEQ ID NO: 21770 - DNA, 638 bp, Homo sapiens
  ENST00000506826
tgttcctaatttttttaccattataagaaacactgaagtgaatattcttatgtatacaactatgaaagcatgtccatgtcattatttgctgtttaaattttacctggggccattatctctagatttgcttgaaatgctcagcttgactccctatcttgagacaaaactactagaaaaatgaatttgtaaagcaaattaatatatttaacatagagtttcttcagcaatatgctgtaaaggcagggtggtggtggtacacaggttgcactggatttttttttaatggcacatttttaaaactactgctcattttatgcttgatatagatttggcgtttaccttttcctaacatataggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagt

SEQ ID NO: 21771 - DNA, 2393 bp, Homo sapiens
  ENST00000344458
ctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccatgtgacgtcagaagcagcccgcccctgcctggatggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtg

SEQ ID NO: 21772 - DNA, 1057 bp, Homo sapiens
  ENST00000421791
tggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctc

SEQ ID NO: 21773 - DNA, 2218 bp, Homo sapiens
  ENST00000373883
gtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaa

SEQ ID NO: 21774 - DNA, 505 bp, Homo sapiens
  ENST00000451952
gtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctg

SEQ ID NO: 21775 - DNA, 6523 bp, Homo sapiens
  ENST00000377044
cggcccagccgagccgggctgcttgtctggccggcggaggctgagcgcgaccctagcaagccgcggcgcccgccgaccagggacaagagcgactcctgggaccccactctgccccgcgccgccgcctcctcccctgttgtcgcggggacgctcaggcccgcgccgcccgggccacgattctcctcctctttctcccggaggggaaggaacggagaaagccgagcggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttta

SEQ ID NO: 21776 - DNA, 2637 bp, Homo sapiens
  ENST00000377057
aagtctaactacatggattggtttctgttttgtgcaggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgt

SEQ ID NO: 21777 - DNA, 3509 bp, Homo sapiens
  ENST00000538669
gatatgcaacagaagttgaataaaaggagagactctgtttctgaatggaaaattaataaatgttaatttcatggaccagtttcatggaagataatttttccatggactggaggtggagggggatggtttcaggatgattcaagtgcattacatttacttagttaaaatataaatttgacacatttccattagtgtcccaaaaggtacttttctactgtacttgacagttgatactgtagttcatctggaagaataaatgagaaagtagtaaaatataaacaaattacagtaatacaagggcttgtttttatcaaatattaaaatggaccgtgaagccataggccagcatagttttggcagagaagagcaagatcagagaagaacggagaatccacagataggtccaagtatgtatgttggcttactatgtgacaaaaatggtaattcaaaccatggaaaacacatttagtcgtttatttatttttagaattgtgtttatccatttatttaataaatagataatagaacttaaataaatagagtatttgaaacaaaacaaaaccattctcccatgttacagtagacttactccctgatagacaatggagaaggaagggtgaggggtggatgacaggaaattactgaataggcacagtgtacattatttgggtgatggataccctaagtgccctgacttcaccactatgcaatcctatgtatgtaatgaaattgcacttgtgcctcacaaatttatacaaattataaacaacaacaacaacaatagactattccctaaaagagctgtgccccagaccatccactaggtcagcagtccccagcctttttgacatcagggactggtttcatggaagataatttttccatggactggaggtgaagggggatggtttcaggatgattgaagcacattacatttactgtgcactttttttctattattattacattgcaatatataatgaaataattacacagctcaccataatgtaaagtcagtgggagccctgagcttgttttcctgcaactagatggtcccatctgggggtgatgatcaacagatcattgggcattagattctcaggagcacacaacctagatccctcacatgtgcagttcccaatagggttctgctcctatgagagttgaatgccacagctgacctgacaggaggcggagctcaggctgtaatgcaagtgttgtggggtggctgtaaatacagatgaagcttcgctcgcctgctcacctcctgctgtgcaacttggttcctaatctactggtacccatccatggcccaggggttgggaagccctgcactaggtgaacgtacgtaaatgatttggtttatgtatgcgttaccccttgtaagagcaacgtgtgaagcccatggtggtggggtggaagagtgggaattggatggaaaatcatctagacttttttctttttggagttctgcttttatctaatatttctattcagcagtcagttcagaaagatactcagtagaaagatactcatgctgaaggattgaaattggctctgactttctaaatttcacatacaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatg

SEQ ID NO: 21778 - DNA, 5217 bp, Homo sapiens
  ENST00000377066
gttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagagg

SEQ ID NO: 21779 - DNA, 5372 bp, Homo sapiens
  ENST00000542935
gttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaagataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagagg

SEQ ID NO: 21780 - DNA, 1437 bp, Homo sapiens
  ENST00000396272
cacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaa

SEQ ID NO: 21781 - DNA, 779 bp, Homo sapiens
  ENST00000474495
ttttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtaaacaaggatgaaaagtggtctgtggccaaggagaaaaagtcagagggtttctttgcaataggagcacttttctttgaaacatctatattgcccatttatggacattgcatggcatctcctgaattttggcccatgctaaaatgtgaagcgcgta

SEQ ID NO: 21782 - DNA, 722 bp, Homo sapiens
  ENST00000377055
ctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacgggagacggtgtatccctatgttgcccaggctggagtgcagttcacaggcatagttgtggtacactacagccttgatctcctgggctcaagtgatcctcccacctcagcctcacaagtagctgctgccaccacacccagcattgattttcaatttttgtttagacttaaacaactacctggactttcattctgtagatgatagaacttccagattcccacttgattttccacaagaataaaaagaatatccacatttggaa

SEQ ID NO: 21783 - DNA, 675 bp, Homo sapiens
  ENST00000377043
ggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagtatgtttctgttactgttatttcaaatagttgagcaagtagtaatttagtggagaaaaagaataacttatgtctcctttgcagcaagcaaagaaagccaattttacatactttgcttctcttgtggggaggctgtatattttgtgttgatggaattaaagagattatacaaattgaa

SEQ ID NO: 21784 - DNA, 581 bp, Homo sapiens
  ENST00000537329
ctgtttgtctttcccactacagcatatgtttcattcaatcaggtatcttgttttggctcctactgtatcctagaattttgcttagttcataccggatatttagctgtcttcataaaacaagtaagtgaagtgctgctaaggggacagcccatatgcattaaacaaaatcttgtatttccacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtct

SEQ ID NO: 21785 - DNA, 381 bp, Homo sapiens
  ENST00000546219
tagaacaatattttttgctacttccctattctgaaaagtatgagtttgattttagtaccttgacttacagataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcac

SEQ ID NO: 21786 - DNA, 542 bp, Homo sapiens
  ENST00000543165
agttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatggtaagtgtgtgtatatgcacatagaacatattctagaagaca

SEQ ID NO: 21787 - DNA, 533 bp, Homo sapiens
  ENST00000545719
accacttcacttgtgtgtgaacataagaagtatgactctgaaatgaatgcttcatgacagcaaggatcatgtctttctttcttgttcaacaccctatgtccagtgccttgaacagttcctgacccatgattttctgaaaactttactcctttgctgcacttcaagtctgcaaaattgacaaatgaaagtgtcggggcagttggggagaaagaggccttcagatatactctataaatcatcaaaatatgatgtgctatatattctcggcataaactggaaatgaaaaaaacttgctacaaataggagtgactcctttgggcttaaattggattggcagcaacacagattctgctgtggattgaagtcattttctacctcggcactactcagtccatggggaatggtgaagttatgattttgcagcaagattctgggagcaggccagcatctacatctgttctaaacttaacagtgtatcatgtatgccactgattccaggggacactcccctgctttcctccaacctcagaatg

SEQ ID NO: 21788 - DNA, 3512 bp, Homo sapiens
  ENST00000296978
ccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagcacacagagccgctgaaaacgactgaagagagcaagggatttcctgggacatctggctctggagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcag

SEQ ID NO: 21789 - DNA, 5017 bp, Homo sapiens
  ENST00000392429
gcaagcatttaggaatagcatttgccaactcccaagacttggctgtccctctcgctctggccttacttacctaactgacctcctgtagtactgagttgtgtgctggccaagttcctattcctggactgctttctttcccttgaccttccttgaaatactgctaacctgacttttgactgtgatctatgtgctatctcctgtgtgaagcctaatgaaaggtccttctctaatggaaactttcattctaggagttacctcattctgttttatgtggatctgttagctccttcattaggtttcaagctgtttgaaacagtgattgaatttgctcacctttgctttcctctcagggtctacattgggaccctgagtgataatagagccttctgtagtattgaattgctttaaacagaattaaaggacattggcaccaaatgtgattttgccaatccttgggagtcttggtgcctctgtctgggcttgaccagggtagaatggctgaagaaaatgtgattcctccacccattaaattctttatttctcaactactctggaagtttttgcctctttttgtttctatccattttcatacttttaagatacccttttttactttaagataccttttttcttcctaacgtttctttacatgctcacatgcaagcccagtcatccatctctctttttcacctttctgtcctcatatatttttcttaaaatatcttttctcatctaatctcctttcctctatcaatcagcctcctaagcgaaaatggtagtgctaatgttttaaaaagtgggggaggactagaaatctgtatggaatgtaattcacttttattgcttttaaattaaatgaaacgtttttgcccttgtttccattctactcagaaggatttcagactaaatccttaagcctgccatatggaaataactgggctagagggctgctatctaatctaagcatttaattcaaacatttgaaatggtttttgcttcaagaaaacataggttgacactaagctttattttagcaaaggtttgggaaaggttctaatctgcagtatgtacactttgataaatttcatagactagagcaacagattacaatttagtttgttcttccaacataaaactattttaatcctagttataatttcactgaaggctggatttactcactggcttgttaaaactgtagataacaaccacaagcctgttatttaaacacaattcagaaatcataaatagaaattcaaaaggagagctcaatgctgcaagatgagatttgatgccctgaagaaactctctctgaaatttgccaaagaccttgtggaacttaaaatatcttcttgtttcctaccagctagatatggcagcttgagaactatttattatgaatcaagatagatattttaccaactcagaaaatgttgctttttgtttggatattaatcttgtttgttcatatttttaactaggaaagttagtacagtaatatggtggtcatccaacagaccacaagaagagaatttgtccctcattcagcattttagcaaatatttcttgaacactagccatgtgcaaggtattacagtgagtgtttctgctaataaaaatatgaattaaatttgatgtttgatcataagtagaagaactgtgatactataatattgtaagtgccatagaaaacttgctattataaaatgctgtaaggagttaatgcttgcatagggtgcagtgggtcagctagagaaggctttataaagaaagtggaatatgagctttgatgcctagccagatgtgggtatgtgaagaacagggcagggcagtggggagtgggtggattctggacagctgaaacattgttaacaaaatctcagaaatggtacaaaatggaatatgaatgagaaatacagaacatttgttaggttttatttttatgcaaattaaagagaagagttagagacaaagttaaagtcaatgggtctagaatttcagctaaaactttggtaggtagtggagaatattttatcattattctgctctttaaacaacttcagagatgattgattaatcttgattgtaaaggaagagaaattctttggaagaccagttagggggttatcatatggtctagtaaaagttaataagatctgcacaaggctgggaagagtaggattagaacagaggggtggaattaaaggacatcgtatattggaaatttctaggatttagaacctgattggaagaggaagaagaaagggaggagttaaaaataactgtaaagagccaaatctgagaactgaccctgctaaaaaagtcagacaagtcaagtggtgcagctggtgtgtgctagaagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 21790 - DNA, 2899 bp, Homo sapiens
  ENST00000617887
cttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 21791 - DNA, 2918 bp, Homo sapiens
  ENST00000545622
cagctcagtggctctcaaacctcagcaggcatcagaatcacctggaggacttatgaaaccagtttgctgggcccgcttggtccagcgcttctgattcagtagggagaagtggaaccatgaatttgcattcccgacaagctcacaggttataccagtgttgctggcccgaggattgtattttgggcagcattactccatctgaactcttcttgttctcttacctccttacgtcccaagactcgcggatgttagtttattctcagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 21792 - DNA, 1245 bp, Homo sapiens
  ENST00000377311
cagggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacaggccagacttttaccctccagcttatgaagagagccttgaggtggaaaagcagagctgtcctgcagagagagaggcctctggcattcctccacctctatatacagagacgggcctggaattccaggatggaaatgactcccacccagaggccccaccatcttatagagagtccatagccggcctggtggtgacagcaatctcagaggacgcccagaggcgaggccaagagtgctgaggcagagaaagctctccagcactcatgatgccaccactgtggggagcagctactgataataaaggcaaacgagggactgtgggaggaaaagccacaccagggaccccacaagagagcttggggaggggatgacagccctgaattccagacataactggccatgccagggcagggcaggccaggggccctggaagggtgtggccaacaccaagcagacatttcagagcattcacactaatcttaaccccggctggccttgggtccccaaaggtgtcactctgagagctctgcttacagagattctttctgctgtcactcaatttccctcccatcacctcaactccagccagggaggaatagatgctggttgtcaggacagccacatgccttcctgttctatatcacctagtaatctcaaagcgaaggtttgttgtttaatttattgattgttcagccttttgttttgttagcttgtttcctagttacctccagctgaccatactaccagagtgaggcagtacttcacatcctgggagatatgccctcggaacccatgaatgttattttgtattattttattttcatgatatgtattttttctatgtaaaaggaaaatgactgtaatatttgccttcaagatggttcaaacacaaaatattaaatgagctgtttcttaaaa

SEQ ID NO: 21793 - DNA, 824 bp, Homo sapiens
  ENST00000472622
cgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagtaagtctttgaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccac

SEQ ID NO: 21794 - DNA, 2042 bp, Homo sapiens
  ENST00000372281
gaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 21795 - DNA, 860 bp, Homo sapiens
  ENST00000372275
cggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaaatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccac

SEQ ID NO: 21796 - DNA, 481 bp, Homo sapiens
  ENST00000372274
ttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctct

SEQ ID NO: 21797 - DNA, 2074 bp, Homo sapiens
  ENST00000372273
ggacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 21798 - DNA, 1963 bp, Homo sapiens
  ENST00000467529
gtgcgcacgcgcatctgacggttgtctcggttactcattgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 21799 - DNA, 847 bp, Homo sapiens
  ENST00000463029
cgcacgcgcatctgacggttgtctcggttactcatccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaag

SEQ ID NO: 21800 - DNA, 785 bp, Homo sapiens
  ENST00000476173
ctcggttactcattgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaaatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagata

SEQ ID NO: 21801 - DNA, 878 bp, Homo sapiens
  ENST00000483732
ctcttaggatagtttctgctttctagtgttcctgtctttgggtcctcacctctgcatggttactaacgggttatccgagcctaagcctctcacgaagcggaaagtcaagttaacagactgccataggcctgccaagtcagaatagggcttccgaagcagaatgtttgagccaataggaattgtttggaaaacggggataaatctaaaggatgggtaggatttaagtggtaagggaggataaagaggctataactgttctgacataggtgtggaagcaagaagaaagctgtacctagaaaaagagcgacgtttgtttggctgagaaataatctgtttaaaggataacgagaaagatgcgtggaaaaccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccc

SEQ ID NO: 21802 - DNA, 407 bp, Homo sapiens
  ENST00000463209
ggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaaggtatgtgaatgagaacaagttatgatgaccccaggaaaacccttctccgggttacctagccaccaactgtgacccttctgaaggaggaggaaacaagcactgctgttcagtgagcctgctcttccaagatggcaactcatctttatttttctttactaaatatcatacacatttacaggatca

SEQ ID NO: 21803 - DNA, 719 bp, Homo sapiens
  ENST00000450179
agagtttcttcggtctgtgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttc

SEQ ID NO: 21804 - DNA, 2154 bp, Homo sapiens
  ENST00000613758
cgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacaccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctct

SEQ ID NO: 21805 - DNA, 366 bp, Homo sapiens
  ENST00000372277
cgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtga

SEQ ID NO: 21806 - DNA, 3394 bp, Homo sapiens
  ENST00000309720
agtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 21807 - DNA, 3425 bp, Homo sapiens
  ENST00000371369
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 21808 - DNA, 2879 bp, Homo sapiens
  ENST00000371352
catttgctatgaatattctctataacaaagcaagacaaatttagcagcacttcattgcatctggatgggggagagagctggacaatttcttgctaacaagagatggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 21809 - DNA, 695 bp, Homo sapiens
  ENST00000519908
acgcggctgcacggaccgccaatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 21810 - DNA, 387 bp, Homo sapiens
  ENST00000480821
aggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatggttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcattt

SEQ ID NO: 21811 - DNA, 3172 bp, Homo sapiens
  ENST00000440464
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 21812 - DNA, 76 bp, Homo sapiens
  ENST00000631591
ggccccgggagagccgggtggggcctcgggatgcagccgccggtgcccgggcccctgggcctgctggaccccgcag

SEQ ID NO: 21813 - DNA, 73 bp, Homo sapiens
  ENST00000633279
cccgggagagccgggtggggcctcgggatgcagccgccggtgcccgggcccctgggcctgctggaccccgcag

SEQ ID NO: 21814 - DNA, 694 bp, Homo sapiens
  ENST00000488362
ggccccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtgagcaggagcactgagattcatgtgggttttgctcagctaaccccgccgaccccacgcggttttccctgcacataggcgtggtctgaatattttgattctaatagttcctgggggtcacccctgcagctggtgaaccgttgatgccccctgtgtttgggaccttgacatttcgatgtgctgtatttcactctggagtcagagttctggacttgcttcattaaatcacaacagtctcaga

SEQ ID NO: 21815 - DNA, 6100 bp, Homo sapiens
  ENST00000375353
cccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtcacctgtcactccctggacggcaagtgccagctgaaggtgagaagcaacacctgttactgctgtgacctctatgcctgcgggagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctgatagaggcgtggagtaaaagataacttgtttgtttttttttttaaaaaaaaggcagcctctagaaatcccgcttctgtggccaacctcctagagaacccgggagaatgttccagaagtctgtcccctcctttcctccctgggcacactggtgagggaggctggaaccaggcagggagtggggccctccagacccaggctggtgacaccttggcttgggctctgctcacatcaaatggcgctgaaagttcccacccggcctcctcctctgagagcaattgttctggtgttttcacatcccttaattaattagctattattatgattttgcaaagacagtgcagccccggcctccctgcctgtgtgttcttgtttgtggacatgtgttgtgcgttacacgttcgtgtgtgcatctgtgtcctggagaagcgcagggcagaagccacccgcccctcgtgctgtgctcctgacgtatgccaggaagggaaggacgcttcggctccaacgcccagcgctgtgtctaaccgcctgtgagttgttagaatccaggggcccggttgtctttcccagccccggatgcaaatctgcctgggccactggcacgagggtcttcccctgagctgtctcccagctacggcgcctgggcttccgctgtccttccgcggcttctccctcaccgcaccttgtctcaggacccctggccgctgggatggtgggggacggtgtttcggggtcctttggctcagggtctggggccgcagcactccctgtggaaaccagcttagctccccgcgggcccagcatgcacctgccgggcacacctggggagacgggtgagcacgcctgggaagcagcaggtcccgggtgggtcacaggccccgggtgggtcacaggacaggtctcaggtgggtcacaggtcctgagtgggtcacaggtcccgggtgggtcacaggcatcccgggtgggtcacaggtcccgagtgggtcacaggccccgggtgagtcacaggccccgggtgagtcacgggtcccgggtgggtcacgggtcccgggtgggtcacgggccccgggtgggtcacgggtcccgggtgggtcacgggtcccgagtgggtcacgggtcccgggtgggtcacaggcgccccagtgacaggagttcaggatgcgccaccccaaagtagccgaagtctcttgaaaagtgttggatgtggggagaggctttctctgaactcctgaagtcagatcctcagggaaccagggactcccagggcgggagggcgggcgagaggtgatcccattgctccccagacgtgccacaagacaccaagtcgccgtctctgctctgtgggccgctcacggttccccagtcactccctctcccctcggaagctggcgcctccaggcctcaccgctctcagggcctcacgtccctccctgcaaagccccccgtgcctacgataaacaagtaccgctcttctcccgtgtgggtctgaggtctccagcttacttcacggaacagtgcccacctgggaggtggagcggggactttctcccctgcccagtcctggatctgggagaaaaaagataaggtggaggggagccacactcgtgcagacacagcctcctgccccctctgctgcccgggagcctccctctgtccgatggagggtctcacacagcctctgccccctccgctgcccgggagcctccctctgcccgacggagggtctcatcctgtgtccagcgctcctgggcagaaggcccacagcgcacatccacacatgaacggtggctggctgggcccaggggccctaacgggcctctgaaaggcctgcagccagctctggtctgtgaacccgccactgcttgtcatttttatcttataaaatccagcctcacaagcttgctgtccaggagaatgtggtcttggcctctcagggctgactggccttgaaccagtccgggaggtcgggcacgagccggaggtgcggcgtcctgtctggaaatcaccgcccagttcctccagggctgtgggtgcctggctccgagtaagaagctgaacaagcagcagagaccaagaggtttctggagcgccgggagatgcactcacgagcgcctgtgggggaagaaaagtgtgccacggatttcccgagtccccagggctctcactttacctcagggaaggctctatgggcgccgatggtgccgtggtcttgtgtgggcggttcctgggcaccctggagctcgggctgtgcccccgaagctgcctggtgcaggcaccagcacctcttggtgtcctaggggtgcgaacagcagagaagctgaactgcaggtctgggcagggagtctatgccccctggagctctggccagcaaagtcacaggaataaccctccttcccctcatgtcagccctcggtcgcagggtgcggtgtgggggcatcagagtgcttccccgaggctgcactcaccagcttcccccaaacacaacatcgatctttcccgacttttaatcttgtctagagtcaaaagctgttcaaaaatattcaactccaaggtcaacagttttgttcttgccacaaaaatgtccttatcctttatcccagccacaaagaatgtgaacaatttgactcaaggttcgtggtggctggagggtcccccaggtcccagggcagctcccacctggcgcagggctccggccaatgcctggcctgcagtgtgggcggcggctgctctcgaggtgcacctgtctcatgtggacggatcctgtctggggccaccaagctctgccagcctgagtcacggtctgatgaaccccctctctgggctccgctggggccttctgatcccagcctcctctgcagggatgggctcccaatcccgccctcacttggttcccatgcacagccgaggtcagtgagaccctggaggccgcgggagatggggtggaggggatggtggggcagggggtgctggggggtttgggggtgctgtggccccggggcagggggtgctggggggtttggggtgctgtggccccacctgcactccctgcctcactgggacagcacaggagacaggcttctcctgcagctcagaggtgggggcctagtgtagctgcaggttgtgactgaggagggcagggtcagagcattgccctgggcaggggtccgttgagactggccccaccttattagcttgggaccttgggttacagggagtctcctcctgcctcagtttctacatttcacacagcagcactgctcacaagagctcccaagcagaggcaactactgagtgggggagggacacagtccgtccacatggggccaacggccacaaagagaggaagggacatgggtgacggtccgtccacgtggggtcaccggccacggagagaggaagggacatgggtgacggtccgtccacgtggggtcaccggccacggagagaggaagggacatgggtgacggtccgtccacatggggtcaccggccacggagagaggaagggacatgggtgatatggttttgctgtgtccccacccaaatctcaacttgaattgtatttcccagaattcctgcgcgttgtgggagggacccagcgggaggtaattgaatcatggtggctggtctttcccgtgctattctcgtgatagtgagtaagtctcacgagatctgactggttgatcaggatttccgcttttgcttcttcctcattttctcttgctcctgccgtgtaagaagtgccttttgcctcccaccgtgattctgaggcctccccaaccatgtgcaattgtaagtcccgttaaacctctttttttcccagtctcgggtatgtccttattagcagtgtgaaaacagaatactacagtggtccatccacacgcgggtctcacccagccacagagagggagaggacgtggcccatccacacgcgggtcacccggccacggagaggaaggaagctctaacgggtgctgaggctgtaacacacagtgctcagggaaggacaccagacatgaagactgtgttctgtttatatgcagtgtccagagaaggcgtgtccacagacagaagccgactgggaaaggaggtgcagtcactgctcagggacacgggttcttttcggggaggcaagcgtgttcgcagcgtgttctgtatggggagagatgcagtcactgctcagggacacgggttcttttcggggaggcaagcgtgtttgcagcgtgttctggatggggagaggtgcagttactggtcagggacacgagttcttttcggggaggcaagcgtgtttgcagcgtgttctggatggggagaggtgcagtcactggtcagggatacgagttcttttcggggaggcaagtgtgttctaagcgtgttctggatggggagaggtgcagtcactggtcagggacacgagttcttgtgggaagaggagtgtccgggagccagatggcagtgatgggtggacggccccgtggatggactgaccaccgacccatgctctgcactcatgaggcgtggctattgctgtgtgaatcacatctccatggaaacgggagtgggagaaacgggccccaaggatgttgtgaagatggccttatggggctgcactggtgacttggacagtgctggccaccggccctgctcagtgaacaagagccatggtcatcaccctcgccacacagagcagctcctcctgcagacttggggaccccgtggccaccagaccccgcggtgggagcagagatgcctccgaaactctggagacccacagaggcagaagaggattccacgaggccggggcccgtcagcagatcctcagacggcgacacgcgccacttccttttctgtttcctagaccttttaactgatggaattcagtaagcagaaaacgtgcttgaaacaagggcaccatggagcggaccctccccctctcccctcgtggagtccttgaccctggggcaggtgacccttcttgctttgcaggcaggggctgtggctggagcttctcctacaaatgggctgtgctgggattagcccggctgtacatttgctttatgcttccgttggcatttaaaaatctgatgttcata

SEQ ID NO: 21816 - DNA, 380 bp, Homo sapiens
  ENST00000483678
gctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgactaagaggagaggtaaagacataaaaccaggagggagcccccggttcacatggcagcaatgcagagtgaaatccagacactgcctgtccatgatgttcgtggctgtatgcgcggcaacagcgatcaggttcagctggaagtctgttttgttgatgcactgttttggggactataactttaaaaacaaaaactggctaattttgtcagttcacggtggcagcc

SEQ ID NO: 21817 - DNA, 487 bp, Homo sapiens
  ENST00000375348
ccaccccttccaacagacactcactgggaagtgcgaccggcccggcgcacctgcgtgggagcaagagccgtcttaggcctcggcacggtcgttggcaggtccatgttggctgctctgagccagattttcgagaagacaggacaggtgatgttgcagagatgcctgcccaacgccagcagacgcacctgctgctcagtggttgaggttcttgagctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtgagtgagatgcggggagtaatgacccgcgggcggccgc

SEQ ID NO: 21818 - DNA, 389 bp, Homo sapiens
  ENST00000498692
ctctgtgacggcgctctctgtgtgtctcgcacctgccctgtgtggattcctggctttaactaaacgcagcctctcatcctcagcacgcgtgtcagaggaggaggagctggaggccctctcagtggccagcacctgccagcttgtctgggactctccagcagctgccgggaggcatcgtgtgtgtgtcacctgtcactccctggacggcaagtgccagctgaagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcct

SEQ ID NO: 21819 - DNA, 645 bp, Homo sapiens
  ENST00000467169
gcagccggattgtagacaggacacagaaacgcttgtctggtgcaggcgccatgctcgccacacaggcccggggtgtccagggttttccggaaggggctcgtgtgttcattaaagcccgtgataaaatgctggagtgcaggatcaggaacaggtgatacctccagggccagcccgcaatgcagagccacaccggctccaggaagtcttcctcgaacccaaagctcagggctgcagagcaaggagaggacttgctaaccttcacacccaccaagcaggccctcttgtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctgatagaggcgtggagtaaaagataacttgtttgtttttttttttaaaaaaaa

SEQ ID NO: 21820 - DNA, 2520 bp, Homo sapiens
  ENST00000388942
cgcgggctcggccaagccgccggcgcgaggcctcgcgcgcgcccccgagcgcggtgggcggaggggcggagggagcggcggggccgcgagggggcgggggggcggagaggggagccccgggagcgcgagccgcggccggcgccgctgcagagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtctaactggctgaagccgtgctgtgggaagagagcagccgtgtggcaggtatttttgctcagtgcaagtctcaacagtttcctggtagcctgtgtaatattggtggtgattctcctgactctggaacttctaatagatataaagcttctccagttttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgaga

SEQ ID NO: 21821 - DNA, 2292 bp, Homo sapiens
  ENST00000484722
agcgcgagccgcggccggcgccgctgcagagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtctaactggctgaagccgtgctgtgggaagagagcagccgtgtggcagtttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgag

SEQ ID NO: 21822 - DNA, 1932 bp, Homo sapiens
  ENST00000559079
agagccgagcgaatcccgagcccgggcagcagaggccacatgagctgtggaaagcacattacctgggaccgggtcacctgagaagatctttgtatcagatgttcctgggatcaaaggcacagtggaatgagccccaagttggaaccagaaagacctcagcaggtagcagacctgaagtgcaagtgaaagaagccaatcttagaaggctgcatactgtatgattccacctatttgaccttctgaaaaaggcaaagctacagagacagaaaaaaaggcacaaagatgaccttgcacatctgctgcagatggcacctccacccagctgtccccagcacagcattgacttgtcgagagctgtcctttgagtctgatggattattgagactttttgaatgcaggaagcacactcatggggccatccaagggccttgcattatttttctgcctttgaaaagccactgaactaaatttggcagataaaaatatgcctgagagatttctttcttaatttgctgattatgagccctgaccgtaaggagcttacggtctagagtagatggtatgtgagcataaaccactataacacaaggtaaactatgattcatagtctgggagaggtaccgttgaagtgggcaagagagagaggaaatccagcccctccccactggcctcaagtggaagcagtgacaccagttctgaaagtttggattggagggccaggtaggagtgagactcctacccactcctatgaaatatgttctgggccaggcgcggtggctcacgcctgtaatcccagcactttgggagcccgaggcaggcggatcacgaggtcaagagatcaagaccatcctagccaacatggtgacaccccgtctctactaaagatacaaaaattagccgggtgtggtagcaggcgcctgtagtcccagctacttgggaggctagggcaggagaatcgcttgaacctgggaggcggagattgcagtgagccgagatcacaccactgcactccagcctggtgacagagcgagactccgtctcaaaaataaaaaataaaagaaagaaagaaagatgttccaagcagagagaattccataagcagaggcagagaggtgaataattgtgtgtgcacatgcactaggaacagataggtggctggagcacagtgtagagaaggataaggaatggcttaaaaggctggggccagatggtggaaggctctgaattcctggccaaggaattgagagcatgttcagtaagcagtaggcacctctgcaggtttgagtcagggaataagcagatcacactgcgcttcagaagagtcaccaggtggcagcgtataggatgtgcctgaagcaccgggcacggtggctcacgcctgtaatcccagcactttgggaggctgaggtgagcagatcacaaggtcaggagatcgaaaccatcctagctaacacgatgaagccccatctccactaaaaatacaaaaaatgagccgggcgcggtggcggctgcctgtagtcccagctactcgggaggctgaggcaggagaatggcgtgaacctgggaggcggaacgtgcagtgagctgagatcgtgccactgcactccagcctgggtgacagagcgagactccgactcaaaaaaaaaaagaaaaagaaaaggatgtgcctgaagcaagatgcccagcggtaagaacacccatcaggaggctacttcagggcagttacaaggacccagacagttggaagctgtctcttctgcgtctgcactcccacggccctttatcagtacttctcttaggtacttaccaatttttaccttatctacatttttaattaaaaatagttgtggttcattataaaggaaaattagacagtatagaaaaatataaattgtaatcccaccatccattaaataactactgttgacactc

SEQ ID NO: 21823 - DNA, 1762 bp, Homo sapiens
  ENST00000561302
agagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaaggtttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacaggatggagtctcgttctgtcaccctggctggactgcagtggcgcgatctcggctcactgcagcctccgcctcctggattcacgccattcttctgcctcagcctcccaagtagctgggaccacaggcgcccgccaccatgcccagctaattttttgtatttttagtagagatggggtttcatcgtgttagccaggatggtctcgatctcctgacctcaggtgatctgcccgcctcggcctcccaaagtgctgggattgcacgtggcctcaaccatattactgtgtattagttcagaaagtgctttcattagattcatttgatttaacaatcaaatcttgaattccttca

SEQ ID NO: 21824 - DNA, 1974 bp, Homo sapiens
  ENST00000558249
cgtggagaaaacgagccagtgttcagaccagcgggcagtgacgccaggatggggtcccccaggctgggacgggggccctgggtgtcctgaggtttcctgttctgaaagaggctttcatgttgtcgagcaccccttggggtcacacatctgggcgaagagctagaactgaatttgcacccagggctcctgactccccgtccagtggcctttccacaaaggaaacacgttgtgtttcctctcccgggcatccgtgagatgggggccagactgcaaggcacctgagacgcaggatcgcacaggttggaaaaggctccgcaaccgtaagaagctcttgcgaaccgcgatgctgggagattcctaaggaatcatccagctgcgggaggctcagcccagtcctccccaccccgcccccatgcaggagcaaagcgcccagaggtcaggctggaggcccccgccggcccctcgccgctgattcagccttgcccgtctccctccgcagtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgag

SEQ ID NO: 21825 - DNA, 2490 bp, Homo sapiens
  ENST00000392432
ggaaacttttccccggcgccttcgccgccgccgcccgcgcccgggagcgcgcccttctctgcccgcggtcggtgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgccccacctccgacactggggattacgactcaacatgagatctggcggggacaaatgtccaaaccatcccagtctccctcacgttctcccagcggacattggcgagccgctgcccagcgtcaggtgctgggcactgagatgtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagtatctca

SEQ ID NO: 21826 - DNA, 1445 bp, Homo sapiens
  ENST00000432352
ctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 21827 - DNA, 1899 bp, Homo sapiens
  ENST00000477651
cactgagatggtgaggacccctgcccagccctcaggagctctctgactgtgtaaagagctgagtcatgatcaatcaaaggtactccgctggagggatgcgttagggcccagaaaagggagttgcttgctcgccttagggtggagttggtaaggggaggtttcccagagttaagttgaagccaggttctgagggatgagtaggagtttgacaggcagaagaagcaactcgagcaaaagctgtaagtctaacagaagcattgccctggaggactggctgcaggcagagggcttgccccgcaacctgctgtgccactgagggccctgggtcttgtgatctgctgcttctcccgcccagcccctccctctctctgcccagtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 21828 - DNA, 2197 bp, Homo sapiens
  ENST00000381975
ggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 21829 - DNA, 2245 bp, Homo sapiens
  ENST00000347147
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 21830 - DNA, 946 bp, Homo sapiens
  ENST00000476750
cttgtgcctcagaatcatcatagacgcttggaaatgggagagatcttcttatctcgttgctgatccaataccacagcatacacatggggaaactgaggccccaaaaacgaaggcaaattagtgacaggaggagaactggagcccaatccctacttgcctccatggctggaacctcaaagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgc

SEQ ID NO: 21831 - DNA, 1508 bp, Homo sapiens
  ENST00000473092
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactg

SEQ ID NO: 21832 - DNA, 846 bp, Homo sapiens
  ENST00000452358
aactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgc

SEQ ID NO: 21833 - DNA, 452 bp, Homo sapiens
  ENST00000429560
atgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgagtgggaccctgaagatgtgaacctcgaaggcagcaaagaaaatgtggagctactgggatcccaggtgcaccaggactctgtgaggacagcacacctgagtgatgatgattaa

SEQ ID NO: 21834 - DNA, 1212 bp, Homo sapiens
  ENST00000419280
acgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattatggagtctcgctgtgttgcccaggctggagtgcagtggcgtgatcttggctcactgcaaccttcacctcccaatttcaagcaattctcctgcctcagcctcccgagtagctgggactacagctgccagtggagctgcaggagctgctagtggctcctggtgtcccttgatgcatggcagtgtcgtttacatttctgccttgcccttcatgtggccttcttccctttgtattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcag

SEQ ID NO: 21835 - DNA, 683 bp, Homo sapiens
  ENST00000467284
tcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcccctgggattcaagaaaaggttcagtccacctttgtgacaaaagtacatttatagacagcatccagtcaatttttcccttctgtgcttcccagcattgcaagagacggggtataagctttataggaattctgcaaggaggctgtttctgtcattggaacaaagtctgcatagtgaagaacgcctgtgcctggagccagtgcagtcctgtgtgggtgtgcgtgtgcatgtgggtgtgtgcacgcatgcccatgtgtgggtgtacctgtgtgggccatgagaacagtgctaaatgccagattgctctgtctgaagagggccaagtcccaggcccgtgtgttcctattaattctgtgcctaaggctcttgataacccaactgcttgttctctctccaaactttctggcaccagcagataagggcatattcccctggatgtctgccctttttaaagccaaatca

SEQ ID NO: 21836 - DNA, 859 bp, Homo sapiens
  ENST00000494894
gacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcc

SEQ ID NO: 21837 - DNA, 1278 bp, Homo sapiens
  ENST00000330115
ctaattgctgttggctcaggaaatgtggacaatacgcaggaagggacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgtgaggccgggggtggggatgggactgtgggtcacatgacagtctcagggcatctgggagcatcctgagagggtcatggggcggaggtgtggcgtcaccgtgggtgcatggacatgggctcagcttttcctgaagagcgttagtgtgtatgacagcaaggagggggtgtgtgtggagagtgggcagccaacccagggcgtcctgaggacggcgggagcctctcggggaaagcccgtgtgttcttccccatttcctatagcaaatgaaaagcaggctctgaggaagaagcccctgaggctgaacccataagagaaggagatttgacaccggacaggcagccaggtgtgaggttctgtgtagatcaagagtgtcttaggccgggcgcgggggctcacgcctggaatcccagcactttgcgaggccgaggcggggcgggtcgcttgaggtcaggagttggagactagcctgaccaacacggtgaaaccctgtctctactaaaatacaaaaattagccaggcatggtggtgcatgcttgtaatcccagctactctggaggctgaggtggagaatcgcttgaacccaggaggcagaggttgcagtgagccgagattgtgccactgcactccagcctgggcgacaagagggaaactccgtctaaaaaaaaaaaaaaaaaaaa

SEQ ID NO: 21838 - DNA, 682 bp, Homo sapiens
  ENST00000430601
tgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatt

SEQ ID NO: 21839 - DNA, 1843 bp, Homo sapiens
  ENST00000376014
aaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtctt

SEQ ID NO: 21840 - DNA, 766 bp, Homo sapiens
  ENST00000451326
cgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggagga

SEQ ID NO: 21841 - DNA, 1842 bp, Homo sapiens
  ENST00000400796
acgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaa

SEQ ID NO: 21842 - DNA, 1861 bp, Homo sapiens
  ENST00000434578
caacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaa

SEQ ID NO: 21843 - DNA, 1931 bp, Homo sapiens
  ENST00000376008
agtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagtaca

SEQ ID NO: 21844 - DNA, 1942 bp, Homo sapiens
  ENST00000428417
cagctgcctatcggcttctcagtgtttgaacttcaaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagt

SEQ ID NO: 21845 - DNA, 4098 bp, Homo sapiens
  ENST00000366835
gtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgacaatgacctcctttggctgcacaccatctttgctgtcatttacctcttcctcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaa

SEQ ID NO: 21846 - DNA, 789 bp, Homo sapiens
  ENST00000496025
gagaactgctctcttgtgcttccttctgtgatcatgagaactgtataactgtgctttctcttttgccctggctgctaggaaattctgcaggtgtcatattttcggtcttaatgtcctaaatggatgtcggtgtttcttcatatgtcctttatggccactgtctgtgtcctgttgggagaagggcaggaggggagggatgcagtgtggaagctcatgcctgtccaggccaagcacaaatccatttgctgacagccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagat

SEQ ID NO: 21847 - DNA, 405 bp, Homo sapiens
  ENST00000482753
tcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcag

SEQ ID NO: 21848 - DNA, 488 bp, Homo sapiens
  ENST00000487971
catctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtct

SEQ ID NO: 21849 - DNA, 5407 bp, Homo sapiens
  ENST00000474478
cagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcttatttttttagagacagggtcttgctctgttgcccaggctagagttcagtagtgcaataatagcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgctgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgcttggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctcc

SEQ ID NO: 21850 - DNA, 634 bp, Homo sapiens
  ENST00000483779
aaaaaaacagtttcctggtggattgtttcaagatttggacagttactggtgctaagtaaagaaatttgggttgagagcagccctttctctttgccgcccacagcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacct

SEQ ID NO: 21851 - DNA, 454 bp, Homo sapiens
  ENST00000436966
gcctttggctctgccagcactggtgggaacctgcaagaaatttgagccctgaacgtctgccttgtcctgttgtcctgtgctccagggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactg

SEQ ID NO: 21852 - DNA, 660 bp, Homo sapiens
  ENST00000487817
ctcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctggttggtatctaaggcccagttgtggtcatggccagggggtggggactggcagtcatggttttggggagggagcagggcggatcttgagcggcaagtgctggagaaagtgcttttctgcatcgacgaaggcacctgaacttgggaaataccacaggagggatggcagctggatgacccgggaccttgagactggatgaatttgcaggcaggaaggggtacggaatcccttgggcttccccagcacttctctctcttacacctatggctttgtatgacagttaattatggacttgctggctggattatgagccagatgtgggcaggagccctgccctctccagccctgtttcccagcgcctgatgcatagtaggtgtttagtcattgttgaatgaattattgaacaaatatttgt

SEQ ID NO: 21853 - DNA, 1018 bp, Homo sapiens
  ENST00000537914
ccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgtctcctgccatgcaaagaaggctcatagagttgctttggaagtggattctttgtacagcctggaagaagacgctgtaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgct

SEQ ID NO: 21854 - DNA, 492 bp, Homo sapiens
  ENST00000378821
atgagtgagcaggggagggagacggaggaggaggaggggggaggtggtgcttccgacacagcgcccatgctgccccggggacctcccgaccaccaggcctcagccctgacgtgcccagggtggtcggggcccccgctgctgcccggccggctgctggccgggctcctgctgcacctcctgctgcccgccgcagccttcctgctggtgctcctgcccgcggccgccgtcgtctacctgggattcctgtgccactcgagggtccaccccgctccgggtccccggtgccgcgcgctgttctcagaccgcggctccgcggcgctcatcgtgttcgggcttctctcgctgccgccgctgctggtgctcgcctcggccgtccgcgcccgcctagcccggcgcctccgcccgctgctgcctccgcccgctgggacccccggaccccgccgccccccggggcgccccgacgaggacgagcaactctgcgcctgggtgtga

SEQ ID NO: 21855 - DNA, 1683 bp, Homo sapiens
  ENST00000394642
cccggggcggggcgcaggcagggaccctccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccact

SEQ ID NO: 21856 - DNA, 4434 bp, Homo sapiens
  ENST00000579849
tccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaagtgtgtagttattgagtcaaattcatatgcatggtgtattgtgggacatacttagatggaaggagagagcctaagaatcctgaggatgatttctgtgtatgcctcaaaatgagatatttaggctgggcgcggtggctcacacctgtaatcctcgcactttgggaggctaaggtgggtggattgcttgagcccaggagtttgagaccagcctgggcaacatggtgaaacctcatctctacacaaactacaaaaattagctgggcatggtgacacgtgcggctgcttggtaggctgaggtgggaggatcgcttgagcccaggaggtgaaggttgcagtgagccctgattgtgccactgcattccagcctgggcgacagagtgagaccatgtctccaaaacatacatatatataaaatatatttaaagacctcttggagttcaggcagaagtgaagatagcactatgaagtagtttccacattaacaatagcaatgacttgaacgatgtgttccccctttcttctgatattaatatctgttcattttgcaaacattgaaagattatgaaagctatgacccagaatcacaattatataatttggatacatacccaaatggcataatttctgtcataagcctgtaggaaaagcttgaattcttcacttctcagattctcagagccagcttgctcttgggagaggggcctggtataggggctgcccaggttcgtagcctatgctgtcaagcatgtttggagttgcacatctgttcccatgtcattttctctgtctaactgaagtcagaaaattcctcagctggattctggggaaccaggaacccatattcccaaatccaagattgggacctggtttgtctttccatttgggcacatttcattctttccaggaaaacaggccacttccaacctgcacaatgtacaccaaaccacagaaccacagctgggatatggagtcaggagagggaagctggagctcaactctcatggactaaaggatggattctggatgggctccaggggacaccttattggattggtggcttccatcaactcttaaaaacgttaagtggtgaactttcccgtcctgtcaagctgtgaatggggaatgtatacaaagtcactttgacttttctatttgaggcctccacagtaaacatccagagtcatcctatttttgtctttttacctccctttcagaacctgttttcgtaattagactggaaagcaattcatgctaagtttgcaatggctgccacagttgtaagtgtcccctgcattttaacctgcactagagccctaagccacagagaagcagttctgaattggtatctcaaataccatccacctggtgtgggtctgcagggtggagagctttcccagcacccctgaagcaatgcccaatgtcgattaccttctctgagtcctggcaagtcctggcacattggctttctggatcccttagatgctgccctttctgttgtgaggagaggttgccgaagatattggaggtgtctgctggactgtaggatttctgatcccactgctgtgtagtttttttttctagtgctggacaagtaagaagcctctggataaatttggtgttggtggctgatggttgaagtggaagcagtctttggggtaggaggcaatgccactcctctaggcccttcgggagttggctgaagttacttcctcccttggaaggggctggttagtgagtgccagggatctcaggactgtctctgtgccaggtgtggtttcccaggcaacagacacattcctaagtgcctagttctctagcgtctgtatacatggtagtagagccttccttccatgtctctcttccctctggcctggaataggagcattagactcaaattctgatgaaaaagaaattacttggagatagagattcaatgtgaagagaacaagatatttgaagtcagaattaggtttgaatttgggctcagtgacttacagtgtgagcttggtcaagttcttaacattctggtccttagcattctcatctgtatggtcaaggctattgtcattgggttggtatgtcaacaagcaaaacggtatgtgtgagctgcccaattgtgggcctggttctgattagccaatgttaacacccttctctccacagcttcccattctctgatgccgctgacccagatggcgtcacctcagttaccatggcttggtccaagcagtgacttctgttcatgggctctggaattgagtggccaaaaatctggaatccctacagtagggagagtagccttgtccctgccccactacaagtctgttcatatgaagacatacaaagccgtcgcctctaatcagtgttcaaagggtcgattgtgcaactcacattcctccagagaaattcccccagcttgtgagatctccaagagggaacacgtattcctggcatccaacttcccctggtgctccccctgacctgcctcattccaggagttccctctccagagaccctgtgtgcccacacgagcagacttttagaaaatggcctacagttcaaaggccctgcattgctttatggccttggaaatgtggggaaagtgtcagatgaagaatttctatcctcctcacctcctccctgtctccaataaatgcataccaaga

SEQ ID NO: 21857 - DNA, 808 bp, Homo sapiens
  ENST00000395149
tggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcaggtaagacccacctgtcccactctctttcgtggcttcttgaccagatctgctctgacttcatgttctctcaagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccag

SEQ ID NO: 21858 - DNA, 826 bp, Homo sapiens
  ENST00000261713
ggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcagga

SEQ ID NO: 21859 - DNA, 424 bp, Homo sapiens
  ENST00000582227
agtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaaggtaaccctctcttatttctctgtgggataaagggtagtc

SEQ ID NO: 21860 - DNA, 806 bp, Homo sapiens
  ENST00000578289
agtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggtaaggagaccaaagcagaaagatcagtaaccctcctggagtctcacaattaatatgaatcagagcaggatcttcaactcctcaacttgtgtttttaactggcacatcttcctgcctgggtgcagcaggtgggaaatccatcatggaaaggaaagaacagacatgagagtcattccattctcttccagttcaaatctttttttgtgaaaaaaatggtagttgtgaccca

SEQ ID NO: 21861 - DNA, 896 bp, Homo sapiens
  ENST00000439138
gggatgcgcccgggagccacagcctgagggtttaaaaagctattttaaggccgggctcggtgtctcacgcgtgtaatcccagcactttgggaggcccgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggag

SEQ ID NO: 21862 - DNA, 776 bp, Homo sapiens
  ENST00000583437
ctctactaaaaatacaaaaaattagccgggtgtggtgtcaggcacctgtaatcctagctacttgggaggctgaggcaggagaatcgcttgaacccaggaggcagaggttgcagtgagctgagatcgtgccattgcactccagcctgggtgacagagctagactccatcttaaaaaaacaaacaaacacaaacaaacaaacaaaaaattttagtccaactggggagcaaattcttctgagaaaggaaaaggcaaatttggggcatggcataaattttaccttggttctcttcaggccctcaggtctctgcaggtgtcgtggaggaacctagcacctgccatcctcttccccaatttgccacttccagcaggtaagacccacctgtcccactctctttcgtggcttcttgaccagatctgctctgacttcatgttctctcaagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactg

SEQ ID NO: 21863 - DNA, 504 bp, Homo sapiens
  ENST00000583120
ttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggtgagcaattggcggcttcga

SEQ ID NO: 21864 - DNA, 3343 bp, Homo sapiens
  ENST00000259365
agctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaata

SEQ ID NO: 21865 - DNA, 2516 bp, Homo sapiens
  ENST00000375175
gtgccaggtcagagctgcaactctgtgctacgtttctgtgtggctttcttgaaactacttctctttatttttgttggcgtggctatttattgttatctgtaacgacgcaatatgctgccgaagtctgggaaggagaggggagctgtaagtctacaccagtgttaactggctaaccttggatgcctgtcatttgatgttggacatttgaaagatggcagcatctctggggaaggagggactgaacacttttgaccacctaccatgtcccaggttctatcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgca

SEQ ID NO: 21866 - DNA, 3259 bp, Homo sapiens
  ENST00000395211
agacaaaacgatcgcggttaaagcttgcggctcagagcccacctggccgcgctgctgggaaacggacggagcggcgcttcaatcagaggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttg

SEQ ID NO: 21867 - DNA, 1811 bp, Homo sapiens
  ENST00000536856
ctttaatcaatgctggcctgagaacaggagcggaacattgcctagtagaccctgaggctttacaacagtgccactgacccctatgtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttgg

SEQ ID NO: 21868 - DNA, 2001 bp, Homo sapiens
  ENST00000540540
gggagacctcatcttccaaccaagcttgctgggctagctttaatcaatgctggcctgagaacaggagcggaacattgcctagtagaccctgaggctttacaacagtgccactgacccctatgtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttgg

SEQ ID NO: 21869 - DNA, 2232 bp, Homo sapiens
  ENST00000299882
gggatacagggaggggccatgtgcgaaccagggagacctcatcttccaaccaagcttgctgggctagctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttg

SEQ ID NO: 21870 - DNA, 2163 bp, Homo sapiens
  ENST00000545579
ccagggagacctcatcttccaaccaagcttgctgggctagctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccagtaggccagactgggccataggggaatgacagggtggggacagtggagggcaatcatcctacattccccggatcctccttggggtcagccccacatgattgatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcc

SEQ ID NO: 21871 - DNA, 1956 bp, Homo sapiens
  ENST00000538955
ccagggagacctcatcttccaaccaagcttgctgggctagctttaatcaatgctggcctgagaacaggagcggaacattgcctagtagaccctgaggctttacaacagtgccactgacccctatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcc

SEQ ID NO: 21872 - DNA, 1524 bp, Homo sapiens
  ENST00000544634
aatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatga

SEQ ID NO: 21873 - DNA, 1320 bp, Homo sapiens
  ENST00000544476
agctttaatcaatgctggcctgagaacaggagcggaacattgcctagtagaccctgaggctttacaacagtgccactgacccctatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacag

SEQ ID NO: 21874 - DNA, 556 bp, Homo sapiens
  ENST00000545265
atgacttggaggaatgaatgaatgatgagtgaatgagctctttgatcttctcttggtgccggacagggcagagagtgtaatccccattttaccgaggctgagagggagaagtgcctctcccatgatcacacacatttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagg

SEQ ID NO: 21875 - DNA, 280 bp, Homo sapiens
  ENST00000545412
tgtcctgtatcaaatgttcgtgtccaactgtctccagctttttgctccaaaaggtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcaggctctgcagtgggggaagccaagcctgactggggaccaggaccatgt

SEQ ID NO: 21876 - DNA, 581 bp, Homo sapiens
  ENST00000539732
aatcaatgctggcctgagaacaggagcggaacattgcctagtagaccctgaggctttacaacagtgccactgacccctatgtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcgggg

SEQ ID NO: 21877 - DNA, 584 bp, Homo sapiens
  ENST00000538770
aatcaatgctggcctgagaacaggagcggaacattgcctagtagaccctgaggctttacaacagtgccactgacccctatgtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggtaggactactgaggctgttaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccag

SEQ ID NO: 21878 - DNA, 583 bp, Homo sapiens
  ENST00000538091
agctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccagtaggccagactgggccataggggaatgacagggtggggacagtggagggcaatcatcctacattccccggatcctccttggggtcagccccacatgattgatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacaggtgggctgcacccctaaggctacgggcctccctccccagcagggacctgtcacagctgagggcaaga

SEQ ID NO: 21879 - DNA, 8805 bp, Homo sapiens
  ENST00000256062
agatagaaaaagtagtttgcttggcatctcccaaattatcttgagcaaacaataaaataagaaatgtttcagaagacaattcggctcccaggcccaaaccaaaactcgaacctggtactttttgtaagtgcgggccaagaaaggggctgtaaagttaaagagccggtggcgcctctgaacacacccgggcagggcgagcaggatgtccttgtccagggagaccccttctcctggctttgaggaaggtgctccctatccccgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataa

SEQ ID NO: 21880 - DNA, 4228 bp, Homo sapiens
  ENST00000551659
gcgcggggagctcgcggcgggtccagctgccgcagcaccatgcccgagcccccctccgggcagacgccgcgcgccgccggggccccggtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatata

SEQ ID NO: 21881 - DNA, 3915 bp, Homo sapiens
  ENST00000552618
gccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatata

SEQ ID NO: 21882 - DNA, 1858 bp, Homo sapiens
  ENST00000552925
actttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgcttaccagaaaaggcagtggcccattaccagcaggccatcaaacttagccccagtcatcacgtggccatggtgaacttgggaagactctacaggtcactgggagagaacagcatggctgaagaatgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaa

SEQ ID NO: 21883 - DNA, 3254 bp, Homo sapiens
  ENST00000319685
gtgctagtatagggagggaccgatggtgggcagggccctagaactcccaagagtatatgccctttgtcttttgctaccaggatgggtagggaaggaccatcaggtgggggtagggctgggcatatctgagctcagaccctccttgggcgggtcttgctgtggctgctgtgggggctgggagtgagattcctaggtcactggaattgtgtatgtaggaggattacggctgcctctgctgagtcatgcaggttgtcagggaagccggggaaagccggcagtcacaggcctcacccagctcccacacaaaccgaagggctggtctcactcccaccatgcccccctcaacaacccccagaccgtaagcgatatgaggctgtctgcctcccagctgcataagaaaagggcttggttcttccctagcctgtggagtctgcacatcagatttgcaccctcccccgagttctggccaggaggcttctcaccccgttcaaactgttacaaagttcagctagagatttccttctctctgtgtagttttatcccctgcttctctcccattggatccctgtggttccaggcaggaacggcctgccaggggagcccgcgagctcccagggcctttctgctgcttcctctaccccagtatttcacttggctctccaaattgactcagctccagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaag

SEQ ID NO: 21884 - DNA, 2758 bp, Homo sapiens
  ENST00000539277
gtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggg

SEQ ID NO: 21885 - DNA, 5547 bp, Homo sapiens
  ENST00000553189
aatttctcggaggctgttgggcagctttgcagatgagaagtgtatcagccccttaagggtttcgttcagatgagacgaggcgggagccttgagctgacagggctgcgtgggttcaggagagggagcagaaaactctcccgagccccccagcccccgccttgcacccttggctgctcccagaggctctccaatctgccagacttctctggatctagactttagaaggtgcagagagaggctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggtaattgtttcacacagtagtttttttcaatgttattgttacatgtataaattaatgttacacagatttttgtactaatgatttaatttgtaaacccatattggacaaccaatctctatgtcagtttcttttggacagaaattacaagcctaattttctcactccaatattctctgtgtatcacaggtcgcttttagacaaagatggtccgttattggccattgatatattctctctcactttggtacagaatctatcaagaacaatacatgatatttgatgtttttattaccacttacttgtaatatttttctgaggaattgcaagtggtctaagatcgctgaactcaacatggagcaatttgataatcctacaaattctgttttaacatctgttagaatattacagaggctcgtgagagaggctcctaagagaatagtttttatggcataaaacagagatgagttttcaatcccctccttcttttcagtcgtgtctaaatgatttgataccagttttcagagtcttagatgcatgacccctgctatggagaaacagatataagttgtcttctctctaaattgatgatatagttttgttgacacacatagtgcccttgatagacagtagattctgctaccataaaattaccagattatctttaaaactcaaactcaacatctctgcaacatgcccggcagcattcagttggcttaagggtaataagtgatttgatactgtatgtcagttttgtagggagcgatttgcatcagaaatttttggaggctccagcaagaagcaaaattaggtcattctatgaatatttaagtgacaaagaatataaacctagttgttttgccctttctccctgtaggataggcgggctttagattaaaaacctctgtctgtgttggatgattttaacgcatgctttagtataaagtgtgagctaaaatggtgatggatgtgtctgtgctatacactggcagtcctcagctgcccttggcttgtgttgaaacagacacagaggctggcttcatcagtgttgcttcatctcacctcaccctggacccttccttttcataagcccctccccctgcctctgacaggctggttgttttgcagttactcagatgtgctaagtgtgcttctctctcacagcctttgcactaactgttcctgcagcacttctcttccagatagttatcttagagtttccaagatatttcatatcatgctggtttctgaccaaatgttactatatcagagaggtcttctgagatgaccctttgtaaataggaaccttccgcagcccatcatgttctctactaccatgtcctgccttactttccctatagtatttatcaccatctaaaacacatttatttgtttatggactttctgccaccgttagaatatttgactctatgagaacagctatgtgttttattcatctaagctcattttaaaaatgatcaagattttaatgatgttgaactttattttagttccttctgtagtatctttgcattcagccttactattaacaaattttgtagcagatggaagtttaaacaggataacgtatatactttttccttacttgtgtgtaagaagtgtcagatggcttatttaaaattgattacttgataaatttaatcttttgtgaactgcagtggcaaattgctatcaagttattgcattttacatagttgaagttgtgaacaattgttaagaacaacaaatgatgactaggatcattatcttttcttacacacaaaggtcccatcttttagcacttttctgttctagatgtgaatgtaaaatgatgtgagatataagaatggaactgaaagattgaaaagttctttcttctgcccctttgggcatgaaaacaatgaagcagctgttgagcataactcaggactgccttcccctctctgactttcaacatcctatcttcatgtttttaactatttagtcataaaagagtgcatcagatgtgcaagcaagacacaaactgttagagaaaaacccacctagcttaacattttttggtagcaaatgaattcatttcttggttgcacaactttatttaacagcatcctggcatttcaaacacccagagtgtatgaaatcagtattgacaaaccttgggcaacatgtaacacacagtgaagccatccccttagtcaagcgacttgtcctccattgccaccatccgtccacatgcacagcccacgcggactgtggttgtgggtcagtgtcatgccaaaaagctctttcctacactcagctgaaatcagccattttgcaggcagtttttcagaagctggatgaaaggattcattctgtatttacatcagcctgacatattctgtatttatatcagcctgacatttctgattttctaggactttttagtttttttcctgccgtacagtgtattgactaccatttccagctctttcagttggcaaacttgataatagttttagttaaataactagtttgtgttttcgattttaaaaaatgttgtgaagatcagtattagttaggaagccctgcagcatatctgtagaaccttctttccaggttgacctttatcttatgccagactctttgggtaaacttattcaagcattcgttaatttgttgaattatattatcctctagctcacctttctcagtcttgtctacagagatgtttcgagacacattttcagacacctgccaaaatccttcccctgatgtaaggctgcaaatctataatatcaaaaaaggaaactaggtttatttggtataccttgctcttattataagcatgctgctgtctgttgacatcatttcccatcctcagtgccaataaaaccatgaatgtaggatttgtcggaaactaatattgtgttccttactctgttgtaacctgaggggagaaatttaatctgttcgcgcaaagtaggggatttgacaaatttgaaaaatagattaatgagttgaaaagacattatatggtagaacatattaaggccataatggagcccaagttttacattgatagataataggaagtaacggtaaatatctgaggagagctttctaaaacatgtgaggaagaaaaccttgtggaaaacacatggtgtattttggaaaaggcttttctatgcattctggtgtgagtagttgagagccttgtttgcagaagaaagtgagggaatggatagaatatcgtggaaaaagaaagatttccatggtacatagggactgtcagcatgtaaaggttgaatggaaaagaaaaatagaaaattaagaactccaggtcagaacccctaagaaaatgagaagatttatggccactgatagacgtggataagccagacagaagcaatattttaggaaagaaataagatgagtgtcaacattgtttccagttaaacaagtaatataaatatataaaggaaactgtgaaaactcagagaaaataacgtatacatcctttattcataatataatacctggagacaacaaatattatcattctttaatatgcatctcttttaaatatatttatgtgttccatactaatatttatacactgtttgtatcctgtttttttcacttgccattaaattatacatact

SEQ ID NO: 21886 - DNA, 593 bp, Homo sapiens
  ENST00000550354
ttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaataataataaagcttgggattatctatgctggagattcagaaaaacactgacagatctgccatagacctccagagctctccgactgttcggttaccctggagaaggtttctaacattctaccttgtgtgatgggagtagaaagtccagagaccacccaacaagtcagcccttcctacacaaaaactcccaagaaatgcctcagctaataagccccgaaagagaaatagtgattctccctgaataaagtcaagatattgatgtgta

SEQ ID NO: 21887 - DNA, 464 bp, Homo sapiens
  ENST00000546582
acctgctgagagctgttgccatgaagagaaatccaacaggagctgtgcctgtagataggcgagaccggctactgccagagttggaggtgggagaggctgttaaaacttaaatgaaagcagacacagcagtgaaggccagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaagg

SEQ ID NO: 21888 - DNA, 3483 bp, Homo sapiens
  ENST00000376234
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcatgaaaa

SEQ ID NO: 21889 - DNA, 3602 bp, Homo sapiens
  ENST00000342624
agagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagc

SEQ ID NO: 21890 - DNA, 2101 bp, Homo sapiens
  ENST00000328767
gagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatg

SEQ ID NO: 21891 - DNA, 2733 bp, Homo sapiens
  ENST00000489713
ctggcaaaggcctgctctcatcaatgtgtggtttccaaagtcaccctgtccatctccattccagccagctggaaggggaaaccaagtgggaatgtgtgcccaagttttacaaccaaacatccaaaatggtacgtgtcgcttctcccacattccataaggctagaactcagccccgcaacctagtttaactgcaggggaggctgggagatgtcatctagttgtaacccagcgagaaaactactggacaactagatttctgcacaagagatctccagagctccattagagattatcatgtgtgttcatcccatttctaaagatgccaaagtgcactggcacttaaggttcacttacatggctgggtttttgaggttgatggctgcctttatcttccagtatgattactgcccaggaaaacactctgttgcatgaactaaaggactgttttatagtgaccaaaaaaagtggggagggggtatctctcgagggcttttcctaggaatcccaaatttctagctatcctgaatcttgtagaactcctacacgcagactgtgaaatcattactatcaggggcttactaaataataaatatgatctattaccttgagctaatttcatagaaacgtacggctgttatgtgtttttttaaagagctgcagaggtcttccgtgattctctagtctatgtgttccttgtctagattgagtaatgaaattgtgaagtgtaattgctgcctaacacagccaagctctcccgtggctgattgtcttgctttgctttcttagggtttaaatgcggtatttgacatcttggtgataggcaaattcaatgttctggaaattgtccagaaggtactacataaggacaagtcattagaggtgagtctgtacttttatctccagcccagacatggaaaatgtcaagtaccagctgatttaaaatgccattctcaaatattccttgtgattttgaattctacaataaccagccttttaaagcacagtgttgaagcagttcaggcagaattgctgcacatctgtacctggctcagccacacttttatgtgaaaatcagccacctctggggctttgcgatgtccttgcagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtgacacccacctagcccatacattttataaagttctttcacatgtttctatctcatttgaaggtagctatttgatttccttttgagtaattttttaaagctctcattagagagcagtacagtgtgaattagtcaagtttaagaggtcacccacgcaaaaggttaaacccaggaataaattaacatgttaaagtcccgtccgccctgtaaaacagcactccaatgggtaacttcctgataaacatcagtttctctgtttttaaaacaagaattgagtaagaacagagattaaagtaacaaatccgtagtatgatttctgagctcccttgttctccttcttcaagggagcagagctcttcatctgcagggagcatttcccccaaaaaaggcagctttggagggcacgggatttatttgaaagggctttgacattatttggtggaaatagaaaataacgtgttctgtagtagctttatatttttggttattgacaggatgtttacgaagatctgattgctcttgattttcttgacaaaaataaaatgagacacac

SEQ ID NO: 21892 - DNA, 1278 bp, Homo sapiens
  ENST00000462211
gtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtgacaccca

SEQ ID NO: 21893 - DNA, 798 bp, Homo sapiens
  ENST00000478272
gcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctg

SEQ ID NO: 21894 - DNA, 333 bp, Homo sapiens
  ENST00000496511
tccatcagcgactggagggtaattgcacttgcagcactctggttctgcctaattggcctgatatgccaagccctgtgctctgaagacggccacaagagaaggggacattgggaatgatcaggtggttccagaagtgtttcaatgctcagcttcgtatctccctgactgaaatttatggtggtgatgtagcaaccaaaaaatggatccttactctgggcctgggatttctcgttatcccatttctccccgcgagtaacctgttcttccgagtgggcttcgtggtcgcagagcgtgtcctctacctccccagcgttgggtactgtgtgctgctga

SEQ ID NO: 21895 - DNA, 584 bp, Homo sapiens
  ENST00000440120
agagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataagcacaccctgctgtggaggctccacttaatcaaatatttagaacctcgttggtgttcatttcctgttcaaagggaggaaaagatcctctgccgaagcccttcacagctgaccgggtacttctgtaagagtgtagaagaaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctc

SEQ ID NO: 21896 - DNA, 809 bp, Homo sapiens
  ENST00000480433
ctcaagccatccaccggcctcggcctcccaaagtgctgggattacaggcgtgagccattgcaaccagccttgatttgttgttttttaagtagcaggagtaatttctttagctgaaatgtaagcatagaggttggggtctgtgtgctaacctgtgttgtgtttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggtttgtatctcaactcttttctggtaaacttaactgcccaactgtgtctcagtaatcatctaagtatgtgttgcattgttctctgtggaatgtaggttaagcattggcctgggccccgatggtgctctcgatttttctctcttttcaacatcgcctccatgatttagtgcctttcttattgctggcaccaaggttctgaacccctgcctcagctcag

SEQ ID NO: 21897 - DNA, 639 bp, Homo sapiens
  ENST00000423847
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatggtgtgtcccgttgcctgttggatctgtctccatcttcactcagacagaaggctatagaaagatgcctgtgacttcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 21898 - DNA, 580 bp, Homo sapiens
  ENST00000475272
aacccggcttcctcctctcccgccgggtccgtctgtccctgcgcctccttcgccgccgactagcgccccctggcctgacgtcaccggcgcgtccgccaatgagctgaggagggacttggctgtggcctgaaagtgacgggagcagcagccaatgttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 21899 - DNA, 823 bp, Homo sapiens
  ENST00000481475
gtagccaaacctcttcttagccacctcactgtctcaaacatgacctggggcagtgtgtccatctcgtgggaagctcaggagtctgcctttgatagctttcttatagaagttagtaattccgatcacccccatgagaccatggtgctgtctgtgcctggggtgtctcgcagctctgtcatcaccaacctcaaagcttcttctaattacactgcccaccttcatgggctgattggcgggcagcgtgctcagaccctgatggtccaagcaaccacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacag

SEQ ID NO: 21900 - DNA, 651 bp, Homo sapiens
  ENST00000460345
cttggtctccccacggggaaggaaaagattttaagaggagggctttgtaagtggaaaaacagttcccactggccctaaacctagtatttaatgatccacgttccaggcaggaaaatatttttgaagaggcatattttttaggcaatttttcctagatgtttgttaggtttctatacattgagagctttttacaaactatagcaagcagggaaacagaggaaccatcctctctgtcaggacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatgg

SEQ ID NO: 21901 - DNA, 6281 bp, Homo sapiens
  ENST00000423613
gtctgctggagttcattttccccaaaaacggacccaccatgggcagacgcaccattagcacagtccccaaaggagatgcccaggactgtgggatggtcttgtgaaggtcgatgcacagatattgcagaggaatgctttaacttctagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaa

SEQ ID NO: 21902 - DNA, 7641 bp, Homo sapiens
  ENST00000350763
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 21903 - DNA, 7508 bp, Homo sapiens
  ENST00000535648
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggattt

SEQ ID NO: 21904 - DNA, 734 bp, Homo sapiens
  ENST00000534839
ggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagatttctatagacacctagctgtgctttcttacaagaaaacatatccactggaccaaagcgcagcccccttcatgctgaagccacttcagtttgaaacgtaaaaaaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtg

SEQ ID NO: 21905 - DNA, 69 bp, Homo sapiens
  ENST00000635336
gcctccacagaagccgaaccggaagttgacaaccttctggtttcagatgccaccccagacggtttccgt

SEQ ID NO: 21906 - DNA, 386 bp, Homo sapiens
  ENST00000473855
ccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaac

SEQ ID NO: 21907 - DNA, 696 bp, Homo sapiens
  ENST00000476680
acctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacc

SEQ ID NO: 21908 - DNA, 566 bp, Homo sapiens
  ENST00000498724
gacacaagagcaagcccgcacgtgtgaaggcatccactgccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcaca

SEQ ID NO: 21909 - DNA, 1844 bp, Homo sapiens
  ENST00000544972
ccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaag

SEQ ID NO: 21910 - DNA, 5517 bp, Homo sapiens
  ENST00000542877
atgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 21911 - DNA, 4946 bp, Homo sapiens
  ENST00000537320
caagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgacca

SEQ ID NO: 21912 - DNA, 6786 bp, Homo sapiens
  ENST00000341037
ttctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttt

SEQ ID NO: 21913 - DNA, 1424 bp, Homo sapiens
  ENST00000243347
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacaca

SEQ ID NO: 21914 - DNA, 501 bp, Homo sapiens
  ENST00000460812
aaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggtaaggttttaaattgaggaccaaaactatgatttgtttctttacagtgtccctgaaagtaaagggacactgttaaatagtaaatagtagttattattcactttttaaagttgaaagaaccaacaccagatgcagcttgctaggttgtaaaatgc

SEQ ID NO: 21915 - DNA, 3944 bp, Homo sapiens
  ENST00000291232
cagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaactctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcagcctcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgtgttttggttttttttgagacagggtcttgctgtatcacgcaggctggagtgcaacgatgggtccccagctaattgcagcctgggctcaagcaatctttctgcttcagcctcctgagtaggtgggactacaggtgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtagctgggactataggcgcccgccatcacgcccggctaattttttttgtatttttagtagagacggggtgtcaccgtattagccaggatggtctcgatctcctgacctcgtgatccgcccgcctcagcctcccaaagtgctaggattacaggcgtgagccaccgtggctggcctttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatgcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttcca

SEQ ID NO: 21916 - DNA, 3276 bp, Homo sapiens
  ENST00000248484
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctc

SEQ ID NO: 21917 - DNA, 660 bp, Homo sapiens
  ENST00000464735
cgttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagtgattcttgtctgtattagagcactaccttcaagaaatggggttctgacctggatttgtgctaccacagtgacttgcatttcaacctcagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaagtggcatctggaacaccagcgagacagaaccattcactcccctggaaagggggatgaagccagggagacaaatggtctagctcagcagatccaactcccatggagcccagcaagctaagatccactggcttgaaattctcactgccagcacagcagtgtgaagtccacctgggacactcaagcatg

SEQ ID NO: 21918 - DNA, 1625 bp, Homo sapiens
  ENST00000382258
gttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggtaaggcagcgactgggttccctgtgaacacagcactgacttacagtagatcagaactctgttcccagcataagatttgggggaacctgatgagttttttttttgcatctttaataatttcttgtatgttgtagagtatgttttaaaataaatttcaagtatttttttaaaaaact

SEQ ID NO: 21919 - DNA, 4151 bp, Homo sapiens
  ENST00000382263
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattctta

SEQ ID NO: 21920 - DNA, 4277 bp, Homo sapiens
  ENST00000403372
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacgggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattcttatttatgtgttc

SEQ ID NO: 21921 - DNA, 1665 bp, Homo sapiens
  ENST00000245817
aaaaagcggcgcgctgtgtcttcccgcagtctctcgtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgtccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttgggggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctg

SEQ ID NO: 21922 - DNA, 2641 bp, Homo sapiens
  ENST00000416152
ctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatgctgcaggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 21923 - DNA, 4223 bp, Homo sapiens
  ENST00000381916
ggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 21924 - DNA, 5270 bp, Homo sapiens
  ENST00000333602
cccccaccccccaccccggggcggcgcaggcgcaggcgcaggcgggctcggggcgctcggcaggagggacggcgggcgggcgctcacctgcgggggccggcgcggggcgggcgcccggcgggccgacgttgacgcccggaggcgagggcggggaggcgggcgcgggactcgggggcggcccggggcgggaggggagggccggggcgggcgggcggtgtgagcgggcgccgagggcagcaccatctggaggggtgggagcgcgcggcctctggggggcaagcgagtgcgctgggccgagccggtcgggggcccccggcgggtcgcgcaggaggagcgcggcgggctgagccctgcgctgccggagcagcagccgcagcgcgtaggggttctcagctggggcccgcagcagctccgcgggctgaagctcggcgtggaggagcggggcggggtgggcccggcggtgcaggaggagggcggggtgggcccggggctgcaggagcgcggcggccgcggccacgagcccagccggggggtggtgtgggggccgccggacggcgcgggctgggggcgcccgccgtggtggacgggctcggcgggctggcctgtggcgcaggaggaggggctggggccccgcgggcagcaccaggagaagggcggaggcagccccgcagtgcaggagcgcggcgaggcccgggccggggtgcaggagcgcggggaggggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgccccgaagccgccccgagctggtggggagggcccggccggtggggccccgggggcctgcgggggaggggcgcctgggggtgcaagaggcgaattggctgcccggggtgcaggagggacaggtggtgcgggctgtccaggaaacctacctgaacgggaaggagccccaggagggagagggacccggcgaggggctcaggacccggaggcgccggcggaggaggaggtggtgactggcaggcccgggccccacggtacctccggggctgaaggggacgcaggatgtaggggcatggggagtcgggcgcagaagagtgcggggaaccgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 21925 - DNA, 3377 bp, Homo sapiens
  ENST00000420716
cgtttgctgggggcttgtacattcactcgcccccattcacttctctcccttcgtctctctacactctgccctctcgtccggccgtctccctcctttgtcctctgtcctgctccgtctctctccccctgtccgcatggcctttcttgcaggggagcctccacctcgcccacctcagcctgccttcttcactcagagtaagtggggctgcttccgatgccttggcccccgcccccgccccctctctctcactcctctcctggaaggtacagagcctgggcggctgggccggaggggaggtgggtgggtgtgtgctgtgagcttccgcggctgccctggcctagcatgcctgccccccctcgagcccgccccccggagcctgggcttctgctcacgagtgtggccctggcttccgcctcggcctcactccctcccagacctgtctgagcttctggagcacgagtgtggccctggcttctgccttggcctcgctgcctcccagacctgcaggcgctgtctgggctttgtggccgttggtcaggagtactgtcctctccaaggatagtccttatagcccctgatggcaggaggcggctccgtgcctgcactaatggtgtgccgtgacaggggcggggatgagggctcactaactcgccagggcgcaggagcagggccgccggggtcttgtgctggtggaggcagcgtcaggcaggagccagtgttgcttgctgcagcttagacggagcgaggcggggctcaccggcccacatggggctgccgggcagagcaggttccgccctcctgatggagtggtcggaggtgcgctgagaacctggccgccggtggctgacctcagacctcggggggagttgggagtggagggttgctgggggacacttggctttctctcccacgtgccacctcccctcgtgtcccagaccctgcctgactgccttcctgttgggctctccctttccatcacagaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatgctgcaggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtt

SEQ ID NO: 21926 - DNA, 4235 bp, Homo sapiens
  ENST00000428187
gttgggtggggaagccggggagtagggctggactgtgaccactgccctggagagaagacagaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtt

SEQ ID NO: 21927 - DNA, 491 bp, Homo sapiens
  ENST00000495247
ctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcgcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggc

SEQ ID NO: 21928 - DNA, 3545 bp, Homo sapiens
  ENST00000464041
ggaagccggggagtagggctggactgtgaccactgccctggagagaagacagaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagtaagagcccctctgctccctggtgtccctaactcatcggctactcaggaaggggcactgtcttcacaggccaccctaaggctgctgttctgtttttggggacagtggggtcagggcagcaggcgggacagctgtgtccctggctccggctgggcgtggggtggaagacaggcagctgtatccgccgaggtgggcctcctcgggctgggtctgcagcaggcccgtccgccccggcgtccctcctccctccttccacggccgagctcagatcctggctttcctcacttccccctaatcctgctctcctgtcccaagccaaaaccaccccacggctccggctctgcctggggcctcctccatctcccggtcctctgcctatcatactggaccgccgtgttcctcatcctgccgcctgcggcctcccgtttgctgggggcttgtacattcactcgcccccattcacttctctcccttcgtctctctacactctgccctctcgtccggccgtctccctcctttgtcctctgtcctgctccgtctctctccccctgtccgcatggcctttcttgcaggggagcctccacctcgcccacctcagcctgccttcttcactcagagtaagtggggctgcttccgatgccttggcccccgcccccgccccctctctctcactcctctcctggaaggtacagagcctgggcggctgggccggaggggaggtgggtgggtgtgtgctgtgagcttccgcggctgccctggcctagcatgcctgccccccctcgagcccgccccccggagcctgggcttctgctcacgagtgtggccctggcttccgcctcggcctcactccctcccagacctgtctgagcttctggagcacgagtgtggccctggcttctgccttggcctcgctgcctcccagacctgcaggcgctgtctgggctttgtggccgttggtcaggagtactgtcctctccaaggatagtccttatagcccctgatggcaggaggcggctccgtgcctgcactaatggtgtgccgtgacaggggcggggatgagggctcactaactcgccagggcgcaggagcagggccgccggggtcttgtgctggtggaggcagcgtcaggcaggagccagtgttgcttgctgcagcttagacggagcgaggcggggctcaccggcccacatggggctgccgggcagagcaggttccgccctcctgatggagtggtcggaggtgcgctgagaacctggccgccggtggctgacctcagacctcggggggagttgggagtggagggttgctgggggacacttggctttctctcccacgtgccacctcccctcgtgtcccagaccctgcctgactgccttcctgttgggctctccctttccatcacagaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggcc

SEQ ID NO: 21929 - DNA, 2331 bp, Homo sapiens
  ENST00000439230
cgcggagccggctgagcgcagggccgagctgcggggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagtgtcctttctctgccttctctccaggacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggc

SEQ ID NO: 21930 - DNA, 5940 bp, Homo sapiens
  ENST00000481865
gggatcctttggcttttcctggaaacactgtcctggtcctttgcccgggttttagggaaggatgagtagtgtcgggatggtggaggcaggagaagagagcagcgtggtttgctgagatttaggggtcttggatctgccactggctcctgataggtccctgggcggtcagtggcctccagatttttgttgtgtcttcagtgaaatgataccggtccccactgcccagctcacctcccggggctgcaggaggcaccggagataatggctgtagagggtcttgtaacctgaacattgcttgcaaacataaggaattctagttactgggaggaagcacagggcagaggccagaagaggccctcagatttgaggcaccctagcccagacggataaggatccaccagctctgggggcgtgagacccaagctggcaagaatctgcaatctggagccaaggctgtgggtgcctcagtggaggccgagtcagaccgacgtggccagctttgaccctcatggcctcctttcttctgtcccttgaccttcggctcctccctgtccaccctggcctccgagtctcctccacttttccttccgtctcagccctcagctctaggcgcccctccagagacccagctgtcttcccaggccccttcccagcaaggactagcttcatctgaaccacacacacactcacggttcaacctcagactaaaattatcctctcccctgggcaggatgaagggcagccgactccctggtgagggtggagacagacagcaccaaatggtcaggccagagaaggggccagggctaaaaatggacaaggaggtgtctgtggagggcccctgcggctccatcgatgcgggttagggctggagtctgcggggtggcgggtgcaggaagggagggtggggcaggactgggaggagactccgaccttggctgggcggtgccctccctctccacacagctgggtgtggggccgctcagccacaggctgcatgcctgtcggtctctttctggcaccctccttgaggccagcatcaggctttgggttcatgtttgggggtgtgccctggacggagtgtgggcctccagccaggctgccccactgacagtttggcaaaaccaggacctatctggaagccgaagccggggatcaccaggtggacccagcggggtgggactgagtgactgaccctggggtgttggattccatctggcccccggctgccttcaaacaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagctctctgtgtcctgccagcgcagcagaggcatgggacccggggctggtagtggctcttctgcccccaaccagggtgtggatgggactggggatgcgtcacagtgtggctcatcccagagtccgtgctcaggatttttggggttttatttatttatttatttttgagatggagtctcgctctgtcgcccaggctggagtgcagtaggcacgatctcggcttcctgcaacctccactttccgggttcaagcaatcctcctgcctcagcctcctgagtagctgggattacaggcatgcaccaccacactcagttaatttttgtatttttagtagagacggggtttcaccatgttggccaggctggtctcgaactcctgacctcagatgatctgcccactttagcctcccaaagtgcttggattacaggtgtgagccaccacgtccagcccatgctcaggtttaactaagcacatttattatttcaactataaaaataatttattataaaagtttggaaagtatttgaaaaacaagaaaaaaaaaatcgcctgtaatcccaccactcagaggaagccgagcctcttcctcccactttaggtattttgttggatttagttaagatacaaattctggatacagcttttaaaatcttgttctttcttctcggcgttgcatttaacattttcccctcagggataacgtgtcaccacagcatacagttctggtgtgactgtttcctgtgcagcagccgtgtccttactgctcagatcacgtgcggtgcattcccagcacctcagagggctcctcattctccgtccactcagtgcgtccttctcccggggaagccgctgtcactcagtgcatccttctcccggggaagccgctgtgcagacttccagctccacagctttgtttttggcattacatttacagcattttccttctacagcaaaacaccttttaatattccattttatgaccagcctgagcaatatggagaaaccccatctctactaaaaatacaaaattagccaggcgtggtggcacctgcctgtaatcccagctactcaggaggctgaggcaggagaatcacttgaacccgggaggcagaggttgcagtgagctgagatcacgtcactgcattccagcctgggcgacaagagcgagactgtctcaaaaaaaaaaattccattttataacatttgaatattctctcatcatactggttatctcttactttttggttggtatttaagcccggcattcccccaggaaggggaggtgtggccgacgatggctcctgagggccagccgtctgcccttctccagccaggcctcacgcagagcacgtaagcccaggcactggtgacatgcttacccacccagatgaggagctcacaggcagggatcgttgagccgagttggagggtggagcaggttggctccgcgtgtctgggacctggcaagtcctgagtccttgcaaatcccgctctgggcaggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagtaagagcccctctgctccctggtgtccctaactcatcggctactcaggaaggggcactgtcttcacaggccaccctaaggctgctgttctgtttttggggacagtggggtcagggcagcaggcgggacagctgtgtccctggctccggctgggcgtggggtggaagacaggcagctgtatccgccgaggtgggcctcctcgggctgggtctgcagcaggcccgtccgccccggcgtccctcctccctccttccacggccgagctcagatcctggctttcctcacttccccctaatcctgctctcctgtcccaagccaaaaccaccccacggctccggctctgcctggggcctcctccatctcccggtcctctgcctatcatactggaccgccgtgttcctcatcctgccgcctgcggcctcccgtttgctgggggcttgtacattcactcgcccccattcacttctctcccttcgtctctctacactctgccctctcgtccggccgtctccctcctttgtcctctgtcctgctccgtctctctccccctgtccgcatggcctttcttgcaggggagcctccacctcgcccacctcagcctgccttcttcactcagagtaagtggggctgcttccgatgccttggcccccgcccccgccccctctctctcactcctctcctggaaggtacagagcctgggcggctgggccggaggggaggtgggtgggtgtgtgctgtgagcttccgcggctgccctggcctagcatgcctgccccccctcgagcccgccccccggagcctgggcttctgctcacgagtgtggccctggcttccgcctcggcctcactccctcccagacctgtctgagcttctggagcacgagtgtggccctggcttctgccttggcctcgctgcctcccagacctgcaggcgctgtctgggctttgtggccgttggtcaggagtactgtcctctccaaggatagtccttatagcccctgatggcaggaggcggctccgtgcctgcactaatggtgtgccgtgacaggggcggggatgagggctcactaactcgccagggcgcaggagcagggccgccggggtcttgtgctggtggaggcagcgtcaggcaggagccagtgttgcttgctgcagcttagacggagcgaggcggggctcaccggcccacatggggctgccgggcagagcaggttccgccctcctgatggagtggtcggaggtgcgctgagaacctggccgccggtggctgacctcagacctcggggggagttgggagtggagggttgctgggggacacttggctttctctcccacgtgccacctcccctcgtgtcccagaccctgcctgactgccttcctgttgggctctccctttccatcacagaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcag

SEQ ID NO: 21931 - DNA, 726 bp, Homo sapiens
  ENST00000424563
ggctctgggggctccttccccctgggccaccagccctggcttggaaccacagcacctgccctccgtgcctggagctgctcaggagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgc

SEQ ID NO: 21932 - DNA, 565 bp, Homo sapiens
  ENST00000478623
accacagcacctgccctccgtgcctggagctgctcaggaggtgggaggtgaggggcaggaggccacaacagccgggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctac

SEQ ID NO: 21933 - DNA, 600 bp, Homo sapiens
  ENST00000411741
gttggccccagccgctggttccctgtggctgctgctggtggggctctgggggctccttccccctgggccaccagccctggcttggaaccacagcacctgccctccgtgcctggagctgctcaggagtccctgaatatctccatgtttgtttggctgcctccgtctccatgtctccaggcggatggctctgtggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtg

SEQ ID NO: 21934 - DNA, 1220 bp, Homo sapiens
  ENST00000489628
cttctctccctgccccatcccagagcctctgacctccttcctttccatgcttctctggctgggaaacttcctttcctcttcccccaccaggctgcaagtgaataagaggcctgggcttagacgatttccccaagtccctgcatcgtgtcgtcaaggggtcctgcccgcttcacacggcgcccctgagacccactgttgaacctggcacagggggtcacaacaagtgtttgctgcatgagtgttttaagtccctggggcggacgcaggtagggtgtttgagagggcttctctttgacccctgcctctgccaggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggc

SEQ ID NO: 21935 - DNA, 1048 bp, Homo sapiens
  ENST00000478715
gtggtgacctccgtggccggcctgtcggcccaggacatcagccagcccctgcagaacagcttcatccacacagggcatggcgacagtgacccccgccactgctggggcttcccggacaggattgacgagacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaagtaagagcccctctgctccctggtgtccctaactcatcggctactcaggaaggggcactgtcttcacaggccaccctaaggctgctgttctgtttttggggacagtggggtcagggcagcaggcgggacagctgtgtccctggctccggctgggcgtggggtggaagacaggcagctgtatccgccgaggtgggcctcctcgggctgggtctgcagcaggcccgtccgccccggcgtccctcctccctccttccacggccgagctcagatcctggctttcctcacttccccctaatcctgctctcctgtcccaagccaaaaccaccccacggctccggctctgcctggggcctcctccatctcccggtcctctgcctatcatactggaccgccgtgttcctcatcctgccgcctgcggcctcccgtttgctgggggcttgtacattcactcgcccccattcacttctctcccttcgtctctctacactctgccctctcgtccggccgtctccctcctttgtcctctgtcctgctccgtctctctccccctgtccgcatggcctttcttgcaggggagcctccacctcgcccacctcagcctgccttcttcactcagagtaagtggggctgcttccgatgccttggcccccgcccc

SEQ ID NO: 21936 - DNA, 737 bp, Homo sapiens
  ENST00000468680
gcgttgggtcccaggtctgctgggatctttctggtaaccgtggacaggtcatgttgcctgctgcagcagcttccagcgtgcctccttatttgcaaaccatagggaaagctgcctgacccacctagagagttgtgggtaaggccgtgtgcaaacaggcctgtacggggcatggtgggtcacgggggctgttggggaggagggccggtggcacacagcctggtcctgaggcctgagctccatcccccttctgccacagtggccagggtgtgaggagggtcccagtgccggggctgccccgccacgcctggcgttcaccgtgccatctctgtcgcgcagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccga

SEQ ID NO: 21937 - DNA, 300 bp, Homo sapiens
  ENST00000486523
ggcgatggcctcgcgccagtgctgggcgcggcacccccgcgtgggcctgtgttgggcggcttttgagcaggagtccgggccctcgtgtcaccgctctgaagtcaaggagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattg

SEQ ID NO: 21938 - DNA, 870 bp, Homo sapiens
  ENST00000438207
agccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtcc

SEQ ID NO: 21939 - DNA, 829 bp, Homo sapiens
  ENST00000430929
gtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggcatcagtttcccaaattgcctcgagggagaggcctgagaaactgcaggactcctagaggtccccagacagcaggccaggaaggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacgg

SEQ ID NO: 21940 - DNA, 876 bp, Homo sapiens
  ENST00000468819
atgtttttagtctggggctccttcctcatgtcagctccctagtggcagagcagtctccctcggtgtctctctggccaccatgatcagtgtcacggacacatcccagcatagccccagttctcaaccgcatggcagggaccgtccaggagttgaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtgtgcccccgagagcctgaagacacgcaccttctcccatgccagcgacacctg

SEQ ID NO: 21941 - DNA, 763 bp, Homo sapiens
  ENST00000447060
tcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggatgaagggcagccgactccctggtgagggtggagacagacagcaccaaatggtcaggccagagaaggggccagggctaaaaatggacaaggaggtgtctgtggagggcccctgcggctccatcgatgcgggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgc

SEQ ID NO: 21942 - DNA, 580 bp, Homo sapiens
  ENST00000433111
gtcgggctgttttcctgggcgaggagaaagggggccgggccgggccgggcgcggtggctcacgcctgtcatctcagcactttgggaggccgaggcgggcagatcacctgagacgaggacgctgagctggattactgggccagttacaggtcttgttcttactggacatccaagcatcccggagttccttcccgtcctcccacatgcatcccctgtgcagagctgcgctgttgctgggtcagggagcatggagtgcacagctgaacagagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcacctt

SEQ ID NO: 21943 - DNA, 541 bp, Homo sapiens
  ENST00000427576
gagggggtgtacacgtggggtggattctcgaactcctagagggaaggtgccctgagctcagccctaaatacctggtactaaagagtcagtggctgcttcagatgccaccagaatgagaagcggtgccttggggccccgggggagaggaagagcctctgccctgggacttcctgtgccggcgatggcctcgcgccagtgctgggcgcggcacccccgcgtgggcctgtgttgggcggcttttgagcaggagtccgggccctcgtgtcaccgctctgaagtcaaggagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtg

SEQ ID NO: 21944 - DNA, 5413 bp, Homo sapiens
  ENST00000361379
ctcggctctgcccctcacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaa

SEQ ID NO: 21945 - DNA, 1750 bp, Homo sapiens
  ENST00000336092
aaactgccccagcaggccccagggaaggacggcaggctgggatgccgtccccacggactccctctcctctcttagccctggcactaagtgcgttcctctggcaaagaagaaaataatttctgtccctcgccatctgctgcatgggaagatgggaatggagtgagcacggcaagacagatgctgcgtcctgcaatggccccaccatggaccctcgtcatccaaccgaagtcgcccccttgcctggctttatcttcactatattgtgaggctgcttcattgaatcttatcccagactttaacttttccatgactgccgtgattttgccatgttgttcacacagagtgtgtctgaccttagctgcattgccaccgcctttgggaccctgagccttcttgccagcactgtcactcccagaggttgcttccactttccccttttccagaaccacttgttcctttgggtggcatcctggaaacttgctgttgaagtctcaactgcctcagtggttcttcaagggaggtcctcaggccaccacctgagaaattgttagaaatgcaagtttctgggctgcatcccagacctgctgaatcagaaatttggggaggagcacggactttggcaccagagagctgggtgcagctctcagctctgcgtcatccttgctgtgggaccctgggttattgctgagccactgtgagtctgtttcctcgtgggtatagtaggtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggt

SEQ ID NO: 21946 - DNA, 580 bp, Homo sapiens
  ENST00000555948
cagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgag

SEQ ID NO: 21947 - DNA, 1100 bp, Homo sapiens
  ENST00000367312
ctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggtacctagagaccagctcccttctctggggtccatcagagtctagaggataatgagggagtccacaatgggcaggcgggttgtacttagtgtggtgcacggatgcacggactaaggcaccgatgagactgatttgagtcggctctcctgggctcagtcctggctccagcaccatgatacttgggcatgtcatttctgtttggcggccctttttgttcccattatctatgaaattgggggctgtatcaaatcagtggttctccaagtgtggtcctgggaccagcagcgtctacatcacctgggatgcaaatgatcagcccccaccccagatccactaaattggaaactctggggtgaggccagccttctaggtgattctgatgcacatgagagtttgagaaccactaggttagagggtccctgggatcccttcatctctgactttctgagaatctatgcacttttaaata

SEQ ID NO: 21948 - DNA, 565 bp, Homo sapiens
  ENST00000555340
tctgcagtctacggcgaggcacaggccagcccagctccacgaggactgaacaaggtgctgtctcactgccaccatgccggaagtgtaagtagtctcactgccatctggggccccaggaagcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaag

SEQ ID NO: 21949 - DNA, 633 bp, Homo sapiens
  ENST00000556362
cctcttcccccagctgctacttgcccctctgggccttcactgtggccctttgctctccctcattccccctcccagtcccatctctgctcagtccccacacctggtctggctgctcattctttccctttctgcagctcgagtctccccagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggat

SEQ ID NO: 21950 - DNA, 6142 bp, Homo sapiens
  ENST00000622580
ctcggctctgcccctcacagtctgcagtctacggcgaggcacaggccagcccagctccacgaggactgaacaaggtgctgtctcactgccaccatgccggaagtacagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaatgtcagtatttatattacacaatattattagtttgtaaaaaccgaaagccagggagcttactgccctggattctttagggcgtgggtcttatcacctcattcatttcttcccttcccctaagagtgccacaagcatggcagttgctcagctgagacacatgaatgggaacagaactgaaatatcaggatgtgacctcgagccagctggttggggctggggatccccctggatctccactctgtcctgtccgagaaaggggaagctgccctatgagtcttttttctgggggattccagaggttgaacgtctgttctgaggctcctcagaacctcgagggaggggacgagagagatgaccccttgcccaaccactggctgaaaaatcttgaaattccctgactttgaccagggaattcccagttgtgctaagccctgcctggtggaatgtccctggaggaagtaaccaggacacgcatacgtttttaatgtacgtataaagaatcgtaaagtgaacacccatctgccaaccactcattttaagaactaggatatggcacatacttttgaagcccttatgcgtccctccccaatcacaaccccttcctctccacaaaggtaaatacaatcctcaattttgtgtttgttattctcttggttctcttcataatgttactacgtatttatgaattcctaatacatcattcagttttggatctttttgtaaacctt

SEQ ID NO: 21951 - DNA, 12949 bp, Homo sapiens
  ENST00000367674
cactagggggctgcttgtagggggatggaaaaaacggaggcttaaaaaaatcatgctgctgaaatttcagcaagaggggaaaagagagagcgcgtgagagagagagagagagagagagagagagagagagagagagagagacagcaaagcagtcccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccctccttccctcctttctttcttgacagtatctcactcttgctcagtctggagtgcagtggtgcaatctcagctcactacagcctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcctaatcccatcctgtcttagaccccagagcctcaaaagcccaaccagcattttggaatctagttcccaaggcattgcctgctcctggccctgggtggcacagtggctatgtgcctgtgagtcatcagccactgcccccaccctcaggtcagacagacagtcactttctgcaaaggtaggagggggagatggttgtagtttttagcacttttgggtcaagcattgaggaaaggactgaagaagtcaaaatcagggcactgccatagagattatagtttccatgggaaacacagatcttccctagccctgttttctccatttctggtcctatttgtcacagattctttttttctgaattgcaaaccgaaggcctcatatctatcttcacccaagccctccttagtgtaggtggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagccaaaggaaattacatccagaaatccaaaggtgaataggtgataactgtgggcctacttcccattttatgagatgcactgtcttcactagcacaatttgatcttaagcccaagagagctagatgctctagaagccgtgacctttcaatttctcctccaaatccaatatcagcaaccatccccgcaacatctgcccagatccatgcccagttccctgagctgtcttctccctttcctctcccattcctcaaggcccagcaccattttctgtagtgcctatgtttgtctgaccagagcagtgtgtacctttgccaaccagttactggatgagccttagtgtcggcaattttctaatggaaatatcctcactcttaccaagctttgagaaccaagatgaaaagtcccttgggctgaccatcaggcctcggacctcatggggatgcagccagccaccattgaatggaggcgcttcccttgccgcaggcttctaggctttgttcactgcggcagtgtggatgtgacaggcataaccctgaaaaacctaggcaccacttgcatttctcagttaaccatgggcttcaacaaactgggaggaggaaaaaacagaaacagatcctttcaacaagcatgtaaattacagaagacttacctagagacggggcaacaatgaatagtaggaagcacattgcatgggaaacttgagggccgaggtacaggccaacagctgtcatcttagctacgacatgacatcggctgggttgtttcacctctctgggccagtttcttcatctgtcagatgagagattagactagaatgagttctaatttccctttcagttttgacggtcaatgatgctaatctgtgatctgaaaacctaagtagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacgaaaatactgcagaaaagatcatgccgagtgagaggctgaactctttttgtccataaaaacagagaccaggtacctgggtggtgccagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcgctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactacagacacatcaggatatgtactaatacccaaaaccaaaaccaccaccaatgactgcaatagattcactgtctagacccaaggtccaggcagtttcccttttttgcatttccccaacatataaagataatttccaacatatcagatgcacattcaccagggttatttctggaaggtgaaggggtcaggtgtagaagaggtggcaagaatgacaagtctgtggaaaactgttggccttgagaccacagtgaactggtggaaggggacttgctaagtgtggccacaaggtggcagtcacctcctgaaaccccgtgtgaaacgtcagcggggttgagaaaggccacgtctccaagtttccaggagagccaaaccaggactcaggaaaaccggccagctgatttgtatgggagattgatttgtaaaagaacaacaacaacatatggcagcaaggaaatgcaaagcaaacatctacaaatatttgaatccacctgtccctcacctaccaacttccccctctactactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaccaagctatgggtgttgaaatagactagctggtgacctggatttgcaaataccctagggacatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccgccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaaataacacagctcttgttcctcagacacactcagccccctctgataacttcataaaacagctccttattgtctgggccatgaagccaggctaatgctaaagttccagttcaaaaacatttaactctattatccttatgaggccagctctcctgggtactggcactcactcactggcaccatggattcaggtcaggtggtgcaaacatcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcatttttttcaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctatgtgagtctattttggttaacacacaggctcctccttccaatcattcacacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaa

SEQ ID NO: 21952 - DNA, 540 bp, Homo sapiens
  ENST00000422274
gatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagg

SEQ ID NO: 21953 - DNA, 5190 bp, Homo sapiens
  ENST00000263525
ccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 21954 - DNA, 10331 bp, Homo sapiens
  ENST00000171887
gttggcccgccccctgggctggcctgggagggaacccgactagcagagccctctgctcagttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctg

SEQ ID NO: 21955 - DNA, 4292 bp, Homo sapiens
  ENST00000446688
agaggtcccaaggatggagtcctggaacctcccacattccaaggctacagacaggaggagggaaccagcataggaactggcatggagcagcttgtgaaggagaggaaaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggtt

SEQ ID NO: 21956 - DNA, 1652 bp, Homo sapiens
  ENST00000490566
aaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttg

SEQ ID NO: 21957 - DNA, 5921 bp, Homo sapiens
  ENST00000419504
aaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcaccc

SEQ ID NO: 21958 - DNA, 5900 bp, Homo sapiens
  ENST00000430930
aaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcaccc

SEQ ID NO: 21959 - DNA, 335 bp, Homo sapiens
  ENST00000480416
cgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagtaagactcccctgcctgctcctcggtggggttctccttcctgtgactcatctattcatccgtgtacccacacatttaccacttgattgattccttgcacccaactgct

SEQ ID NO: 21960 - DNA, 565 bp, Homo sapiens
  ENST00000495556
ggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaa

SEQ ID NO: 21961 - DNA, 2464 bp, Homo sapiens
  ENST00000446903
agatgctggcggagccggagcagccgcggactcagagagcccttctgccagcgccgcggggactctagcttcaggggctcttcacaggccctgggcgtgcctcagtgacgggacccagcaaagatgacgtggatctgtctgtcctgcatgctctggccagaggatctggaggcccccaagacacaccgcttcaaggtgaagaccttcaagaaggtgaagccctgtgggatctgccgccaggtcatcacccaggaaggctgcacctgcaaagtctgcagcttctcctgtcatcggaaatgccaggccaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagc

SEQ ID NO: 21962 - DNA, 2513 bp, Homo sapiens
  ENST00000479185
tgcccctccctcatctcccctccagcagcccactctttttctgcccacctctctcccttagcaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggtataagccgagttagaattcattctctcactccttccttttatcctgaccctatccccagcacccttccacccctggtctgttccacagtgatcaagttatttttgagaggcaggccatcagtaaaggatctgggtttcagagtggacccctagctaaacatgaaccagtgacttaatctctggataataaaaataaaaaagcagacagagaggcactgggttggataaactgttctggtcccattaggtcatcagcctgttatattcagagactgaggtccttggtagatggagggagtggctggcgggcagggggcacacaaaggtgctggatagaagatgtgtatttatgagaactgaggtgattcaacctgaaggctggtttaataataaccttgaagcctctatactggttataagtggagaccagttgttcaccatcttattcgagaatggaatgaaaggagatgaagttaggttatgggcagagggactctggatagactaaagaaaggactgccaagccaggaaggtaactcaccctgacagacttgactaggagctatgctgtctttgagccaggtttttaaaaatttacttatttatttttattttaccttaagttctgggatacacgtgctgaatgtgcagatttgttacataggcatatatgtgccatggtggtttgctgcacctgtcaacccatcgtctacttttaagctctgcatgcattaggtatttgtcccaatgctgagctgggttttctgtggatggctgggagattctgccgtgccccctaggtttctgtctggagcggagagcgttttaagagggggcagggccatgcctgggatgaccctttggaggctttatgtcctttcaatgtcggggctgtgatttccctgctgtccctgatcccacgtagctcataagcagcctgccccccacccccagggtctgaccccaggggcagactttctagtctcttggcactgcctcaggagccccagggacacagaagaaaaagaggcaggtacccagccaggggtcctccccgctttcttccagggggtcttcattcttcagtgcctgtcctgatttacccctatgacccggcatgagccttttcaagaatgtgagaaactagactcccagttctcagtccagcttaagccactggtcccgcccaccacgctcaagaaaatgagaagtccctcagggagcctcttttggggagcttgtgggctttctctgtttttccagctgctgatctcttttccctctctgcactgtctccccgactgccgctgcctttcccatcccacttaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggc

SEQ ID NO: 21963 - DNA, 758 bp, Homo sapiens
  ENST00000480665
gacagtcggagggagcttgagtaggacacagacagcacttggagctgcagccatgtaggaattattgggaacttggggcaccaggatcaaatcagagcgggcttccctccgcttcctccctctccctccctccctccagaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggagg

SEQ ID NO: 21964 - DNA, 1478 bp, Homo sapiens
  ENST00000413554
aggcagcctgactcccatggtgagcccactgccaccaccacattgccctggggcagccctgcatgtccagccctacaaagcggcagcatcccatggaccgcatggggcctctccaggtggagcagggagcatgcctcttaaattagtggggaaggttctgctcaagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacg

SEQ ID NO: 21965 - DNA, 1792 bp, Homo sapiens
  ENST00000310858
gagccacccagtagtgtctgagtggtgatccactcttgcctgcaatgaggaccaaggcaaaaagagttggctgaatctgcagcaggaaggatgagggttagataccaggaggaaattcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcata

SEQ ID NO: 21966 - DNA, 601 bp, Homo sapiens
  ENST00000453356
aggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggagggggcccagcaccctcagattggccaagacaccccaccaggcccctccgaccccccaggctgcttgtgaaaagcactcctccatccccgggcgctgagcggccaagcagaaagcagaggctggagcgaatttgttctgaggtttcagtggctgccagcctaattggtcgttgtgctggggatgtttgcatttttaacaagaacatttggcaattggaaagaa

SEQ ID NO: 21967 - DNA, 957 bp, Homo sapiens
  ENST00000492338
ctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtgggtctctggggctcacagccccttgcatgtatgtgtgcactcactctatgtggggactagacttgtgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatggggaagcatgagtctggggataagaaggcgctggtctaggaaggcatgtgctgttcttggccctggaagcaggattgcttcagtgcttggatgagtctacgggagactgcatcactgccccctgctgtgggaggtcagacactcatgataagggtcaccttctgttgggagagtttagacagttttactgagagctttcaaccacatggtctcattggagtctcacaatagcccaggcaggaaacagggcagggatggatttattcattcagcaaaatttaaatcatctactatggctccaagcactgagatatctgggtgaacaggaaaaagtcctttcccttggtgagctgatacctaatgagagagatggacat

SEQ ID NO: 21968 - DNA, 667 bp, Homo sapiens
  ENST00000413280
cttccctccgtccctccttccctccttccttcccgagcgcggattgcgggctggggtgggaggagatttcgcggagtttccatttcatacctcgcggctaaaactttctttctgtgtctcgccctcttgcagtctgcagcttctcctgtcatcggaaatgccaggccaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgc

SEQ ID NO: 21969 - DNA, 538 bp, Homo sapiens
  ENST00000439083
agtagccccacttggctcttccctccttcactgctgaggagctgctcattggtccgaggcagctgggactctgggcagagccttcttccggacagctggatggagggtccccctcttagcagagctgctctaacttggggctcagctgggagctggacctcggaacccacctatcctgcctcgtaggcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctg

SEQ ID NO: 21970 - DNA, 548 bp, Homo sapiens
  ENST00000423413
gcaaaacgcagtgggaatgtcaagcaggaggcagctcatgtgagctggcagagcggaggaagctttggagaagaggtaccatttgagatggattttgaagtttggcaaggagttttgcggggaggaaaaggggcaaagacttcttcaggcacaggggaaggcatgtgcagaggcccagtggcatgcaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtg

SEQ ID NO: 21971 - DNA, 582 bp, Homo sapiens
  ENST00000449814
agttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacgcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctg

SEQ ID NO: 21972 - DNA, 393 bp, Homo sapiens
  ENST00000465306
caccgcttcaaggtgaagaccttcaagaaggtgaagccctgtgggatctgccgccaggtcatcacccaggaaggctgcacctgcaaagggctggaccaagaatacttgctgaggccctgacagtggggagggcctggaaaactccctggttggagtctgcagaggtaggatagcttcccccacgcaggctgctgctcacctcctccgcgctgcgtgcagccatctggcaatcatgaactgagctgtcctctgggtcagatgctgtgccaggtcctggtgctgagagccagccccttacctgggaagacagacacagtcagacaatcatggagcacggtaccaaagctgacacaggtacgtgcgtgcgtgcgtgtgtgtgtgtgtgtgtgtgtg

SEQ ID NO: 21973 - DNA, 6509 bp, Homo sapiens
  ENST00000611415
aggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaagg

SEQ ID NO: 21974 - DNA, 6488 bp, Homo sapiens
  ENST00000615025
aggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaagg

SEQ ID NO: 21975 - DNA, 5070 bp, Homo sapiens
  ENST00000428457
gattttctgtgccttggacccacaagacaggaagtggatcaaagatggcccttcctcaaagtaagttgctgagatttctttacattctctccttgtctgcagttgtactccaaagttgaattctcttccagatttgcacagggggtgccttataagaaaatgactacaccatgccaatttcttttaaaaaagaaaaaagtaaaagtgttctcattatggacaaggatctggatgctgttaacttttctgccggctgttggctggatgtgcaatatttacatgtgtcatataacactgtggcatagatacagggagatggatggcacagcctttttggccatttgggaatgcatgggctcagcagtgctgaggtctgcacagctagaaggaattgctccctttgtgcaggtgtgtggatgaagcgggtgttccaaatttaccaaatgcaacggaggagggccttcatcacaccgttgctccacagccagtccaggcagctgttagagtttttttttttttttgagacagagttttgctctttttgcccaggctggagtgcagtggcgcgatcttggctcactgcaacctctgcctcccgggttcaagcaattctcctgcctcagcctcccaaatagctgggattacaggcgtccgccaccaggcccagctaattttttgtatttagtagagacggggtttcaccatgttggtcaggctggtctcgaactcctgacctcaggtgatccacctgcctcagcctcccaaagtgccgggattaaaggtgtgagccaccgtgcccggcttagagttccccttttataagcacacctttccctggctccctgagtaccgtggccttgcttggcctgggctcattcctggcccagtgttcctgtcagggccagctgagggacctcatcctaacctcccacttggaggcacaatgggctgtatccccccagcctggtttcctcggcataacccggatttaatgaccacagtgcctgatcacaggcatccttccctggaatcctgttttcaaatggcttgtctgtccaggaagttgctcagtgcatgcgttagcagaagcggggagaaggagaagagaccctggtactgacgagctgggcttccccggtggggactgtgttctgggcacactcccactctggctggtagcagaaacacgggctttcatgtgcttggaatttgtgactgtattggggttacctgagtgtcattgactggtcccttcatgatgcggaaactgctaaatttaaacaaaaaaaatccttcatttttctaagaaagagaagaaagtcctttgcccaggacctggatagggatatggtcattattgtgtgaagtgcaggactcataaaagcctattaagataatggctctaattcttctaagaaaaataattcgatgggctgttctttttaaacagctccctgaagtctatgtagtttgtaatgcaggcttccaaggcctgagaggagcgcctagtgtatttccccttcggtcccagtgggtgggagtgtcgaagtccagacaggacttgcattctggcatcatctcaggagcccctgagtcccttgccactcgccttgcagactgtggtccagtatgtcaggactggggctcaggaatctgcagggacaggtgcccaggagattctggccctggcgtggggaagcatctatagaggaagttgagcctcagctttgattcaggtcctaacctggggctgtggacagggcactcacctctcagcctcagggtcctcactgcagagctagagtcagacatcccatctgtaggtctgtgaaggctggaggtaaagtgcatgaacaggtggccagcagggtgctgggcacgtggttgatttttgataggtgccacttaaaattcctcctgacagtgccgctggcagctggaggaagtagaagcttggtactttgtgggacactgaccactctgactggactttcctttggcagagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaa

SEQ ID NO: 21976 - DNA, 7618 bp, Homo sapiens
  ENST00000311160
agccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaa

SEQ ID NO: 21977 - DNA, 3836 bp, Homo sapiens
  ENST00000457718
cgcgactcccactaggctatgagctacaggagggagggtaggtcttgctcccggagagcaccttaatcacaggcgctgaatgaaagaatgaactggttgtgcaggaaccaggatccgaacccgcctccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagc

SEQ ID NO: 21978 - DNA, 1832 bp, Homo sapiens
  ENST00000450444
caataaaaagccaccttcaaccatttgccttccactctggcttgcataggcagtgggctggcctgtgctcctggccgttgttcctgggtggaccccagagagtatgaatcctggtactcaggttggaggagttttatcctgctgggggctatctgttcattgctgaattcagatttctttggccggttcctgtgggcaccatgccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgc

SEQ ID NO: 21979 - DNA, 584 bp, Homo sapiens
  ENST00000469470
agccttaggagtatttgaaagcttgtgctgtgaaaaataggaatcttacaggagaatcatatggggcctggagaggaacctgtttgggacaggccgattcccatctcctgccactctgtacctcctgggcaccgtggcctgccttctcctcccttctggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagt

SEQ ID NO: 21980 - DNA, 357 bp, Homo sapiens
  ENST00000485555
gggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaaggtgcgtgtgttcatcttgtgtgcagttatggaggcaaagggcacagggaagacagcccactcaaatatctgaagtattttgcagtctgctaagaagaaaaaatttcccctgttttctcagaggtccagaatcacaccttcgtgtgacacagttgtgagttttgagggtcttcgtgagaataaggcatggtgagtttgggtcagggc

SEQ ID NO: 21981 - DNA, 1166 bp, Homo sapiens
  ENST00000442536
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtgaaatgctacca

SEQ ID NO: 21982 - DNA, 570 bp, Homo sapiens
  ENST00000415929
ttgtcagtcttgatctgctacagctttgtagccagagtgaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttg

SEQ ID NO: 21983 - DNA, 698 bp, Homo sapiens
  ENST00000413551
aggctggccctcagccccgggcggacattgtcctgtgagctccatgcctgcgtgctcaccgtggggccgggcacacctgccagctgctcctggctgtggttctggggactcccacactcaccaggctctcccacctggtgggctattccagctgcctcctttatgcccagagctgccgagacattaacacgaagaggggtgtgcttgactaaagcaggggaaggagcgaaacgtaggaggagctgtttctggaagggaaaagcagccctggccggtggtccctgcccaggcccagcacagctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcagg

SEQ ID NO: 21984 - DNA, 560 bp, Homo sapiens
  ENST00000434451
ccactcgagtgggacccgtggcgcccgggcgccctggactgagggcagagaccggagcagctatgtcgcagtcgctgtcgggaccgagcggactttgctccctaggactccgtctcgagactccaggtggagagcgcagctaggggcttcaatgggcaggctcaagacccttctcctactttttctaggacttgtccaaggtggatctgagcctcctcatgtgctccaggcagagatcaggattcggatgcatcaccaactggtggaagatggggactaggcaccctgcacaccctgcacagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagt

SEQ ID NO: 21985 - DNA, 775 bp, Homo sapiens
  ENST00000474346
gcctcgttgcggccatcgccctgccggaccgcgcctcaggctcccccaggaggtgttgctgaaggggatagcagagacctgaggaggaggcagtatggcaagaacagtgagtggaagggctgacctaccatttggcagtcgcagcttatatctgcttaggactctacacaaggacccattttacagatgagtaaaataccaagtaaattcttaaagtctgggaacagttagggatctgaatgagcccagttctctgactctatgtgccccattcctttcttaagatcagcctgttgtaaaccacccctgttcaggggaagcctcttgttccctccctgtgtccctgtgtatgaacttgagagggggaggaactttccaccttcctgagggcagaaagcattgtttagatccctgccacttactaggaagccagagacatttgctgagtgcctcagcagcacgcttagaattgaggcttcgaggcttcctcacagcggcccccatagatttcccagggaggggcctcctgtcttgcgggttgatctggtgggtttgccccatgcagcaggagctatcatgggaagggtgggtctgggcgtctgaagctctccaggaggtcagctgaccctgggaccccgggtccttcctgtaggaccccagaaatcactggggaatcagctaacccctgcaagctgtgcctggaatgacctagagccagtcctgtctacctagaatcctctgctgctatccttgttgatctagaatgagggatgct

SEQ ID NO: 21986 - DNA, 1156 bp, Homo sapiens
  ENST00000458317
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtta

SEQ ID NO: 21987 - DNA, 2229 bp, Homo sapiens
  ENST00000499247
gaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaa

SEQ ID NO: 21988 - DNA, 1467 bp, Homo sapiens
  ENST00000268957
agtgcggttccttctaaaaaggagaggcgggagagtcagggtggagaaggcggctccaaccagattttgcgtccacaaagccaaaagcttctaggcctggcatgtacggcgggtttgtgcccgaggagcacagctggtctacacgggcccgccccgtagacaccctactcctcgactttccccttttcccagtccgagtttgacgtcggtctcctggataccaggcagccaatcgcctcgttgcgaagggaccagcgcagccaatcaggcgtcgttgctacctgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaa

SEQ ID NO: 21989 - DNA, 889 bp, Homo sapiens
  ENST00000509385
agaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagccccttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctct

SEQ ID NO: 21990 - DNA, 2442 bp, Homo sapiens
  ENST00000570371
tgagtaaggaagttgataaacggcaacatctgaaatagctactcgccctgaataggcaggtggagaatattagttacacgtgggacaaatcccattatgagacatatcatcacaacaagaatatttcattctagattttagaatcccaggttttggctcactttggtcaagaaaaattataaataattgagttacagataattaaatgttagcctcctggagtgcatggcaattggttttgacctctatattaaaattcacaagaccacggacataagtcaaaacaggtccccttcgtctccctagtcaccatctccagggctaaaaaacagacttgaaatgggtggcagttagactacaggaaacaggatctacaagcaccaggagctcatctatggctatctgacatcgcctggggacacctcactctctggcaggctcctgctggctggagattgttaacatcgccaatcagatgttaattgaatgcaaaggaataggaaataaattctggttctgaaggggcagctggaaaggtgttgggcttctcagattccaacctacattacaaagcaggcctaaagccaagcatactccttgccagaagaaacggaaagcccctctcccgtttttagaatcaggctggaaaacacggctcccagaaggtggggttagaaaacaagagcttgcgaggcggcgccctgtggtccctcgaggaaatagtagagagacaaagagggcctgctcctgggaagccctaaattcgaagccaatccttcctcctagacatgaccacaactttaaagggcagggcgcacacctcccctcccggatctctaggacaaagggcagccaaagaggcgcagagaagaatgacaaggtgcccagcaagcggcaggatcaaagcctgggtctctaattcccaggctggagattctgggctgcctgctcctcctgcacggggcgaaaagcccacctgggatccgagcgggcggccgcgccactctcgcaggctccatacacccgccactacccgcctgtaccacctgcagccggcagcgcagcctcctcgcgggtcccgcagggcgcgctgcaggtgcgctgggcgtcccgaagccccgccctcgcgtccctgccccgcgcccagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaa

SEQ ID NO: 21991 - DNA, 559 bp, Homo sapiens
  ENST00000574744
gggacacctcactctctggcaggctcctgctggctggagattgttaacatcgccaatcagatgttaattgaatgcaaaggaataggaaataaattctggttctgaaggggcagctggaaaggtgttgggcttctcagattccaacctacattacaaagcaggcctaaagccaagcatactccttgccagaagaaacggaaagcccctctcccgtttttagaatcaggctggaaaacacggctcccagaaggtggggttagaaaacaagagcttgcgaggcggcgccctgtggtccctcgaggaaatagtagagagacaaagagggcctgctcctgggaagccctaaattcgaagccaatccttcctcctagacatgaccacaactttaaagggcagggcgcacacctcccctcccggatctctaggacaaaggcaggtcgaggggcagccaaagaggcgcagagaagaatgacaaggtgcccagcaagcggcaggatcaaagcctgggtctctaattcccaggctggagattctgggctgcctgctcctcctgcacggg

SEQ ID NO: 21992 - DNA, 2507 bp, Homo sapiens
  ENST00000575882
aaaagcccacctgggatccgagcgggcggccgcgccactctcgcaggctccatacacccgccactacccgcctgtaccacctgcagccggcagcgcagcctcctcgcgggtcccgcagggcgcgctgcaggtgcgctgggcgtcccgaagccccgccctcgcgtccctgccccgcgcccagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaacaa

SEQ ID NO: 21993 - DNA, 1026 bp, Homo sapiens
  ENST00000570965
agcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagctcagactcaacagctttttcttggcagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagag

SEQ ID NO: 21994 - DNA, 2228 bp, Homo sapiens
  ENST00000445275
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataatccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactatt

SEQ ID NO: 21995 - DNA, 1895 bp, Homo sapiens
  ENST00000348161
gagtcgggagccggagagcggtggaggcggatttcctgggcccggccctctggcgctaccatggcgtttggcaagagtcaccgggatccctacgcgacctccgtgggccacctcataggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctgg

SEQ ID NO: 21996 - DNA, 2337 bp, Homo sapiens
  ENST00000572405
ggatttcctgggcccggccctctggcgctaccatggcgtttggcaagagtcaccgggatccctacgcgacctccgtgggccacctcataggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcaggtgttgtacgatttcagggactatcagtcaaagtgtctcttaaagttattctctaaactttgagtttggagatggaagacaccttaatattgtctagtacatcctcctacatcctgatttcagttgatttctaaacttaacaaaaatatccaagaatgactttgtcagaaatgcagtagtaacttagacatggtttttagcctcttgcaacaaataatttattataagttataaccttggtcatgtacaatcaattctctagttgttttaagtatgtaaaaattgcctctattttcatccactcaacaaacattgagtaactgtgatataggaagggatgtagaaatgagaaggaggctattctagtccttaagagtttatgcctaatgagcaagattggtttgtaaacaacaaacataatgaagtattatagatactgtagtataaatttgttcagtatatggtgggatcatgggtggggagaaggagagatgtgaggtttttaagaatggtctagatggaggcaatgctcgagctatagaggaacaagtagacagggcatttagacctgcatgagtagttctacagccctcctatgccttctgctatgtctgtgtatacatatactttatttttccctctaccagtttgctcttctaattattttaaattttaaaacttattaattttagaagcagttagaaaaaaaaatcagtttctagtttctaagtccctttgttgccaagttaagaagcttaagatatttttacttttctcagattcccactcgccacctctcatgttatttttcctttaacttcttagattgttagtaaataactttttccttgctcatttcttatttgggaaacaaaaaaattgtaaaaattttcccaacaatgtttcttagatatcactgctgtcgtgaatagtttgttttttccttgctgcagtacacccatgttggtaaactttggtgcaaactttgagtgcttgcatatccaaaaatgtcctctgattgtcatgttaaatgcaggttagtttagctagatataaaattctaggcacaaaattctaggcctttgaagatactgcttcactgttctcttacacccactaatgctgatagaagtattatattattctgcttcttaatcctttgattaataatatttttttctagttgcatttgttatttttctacgttaatatttcagaaattgtactgttccctctgaagagatatatgtacatgtgtgcagatgtttgtttaacttacttatcttccttagtagatgataggcttttttgccttatcaacttatgtgtatttttaattctaggaattctcagctcctactttaaatattgactttctaccattctttctattctcttcttatggaactttaagacgatgaaacttccagttggattcatttgtctcttaacatttcttttatacttttcatttcttcattctaagttctgggataatttctctgtttaatgtatttctctaaaacttgtaattgagttgcttattcagtccttctaataaatgtttcaacaatttctttctattaaaaa

SEQ ID NO: 21997 - DNA, 1252 bp, Homo sapiens
  ENST00000576932
ggatttcctgggcccggccctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagataccccctagagacctggttttaccatgttggccaggctgtggtctcaaactcctgacctacggtgatctgcccacctcggcttcctgaagtgctgggattacaggcatgagccactgtgcccggctcataggccatatttatgacccatttactaacaggcaacaagctaagaagtatagaaatgcttactaattacttaacctatgaggtttgcccaaaggaccagccaaaacctcacctcaagccacgcatatgataa

SEQ ID NO: 21998 - DNA, 1521 bp, Homo sapiens
  ENST00000572158
atttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcaaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcct

SEQ ID NO: 21999 - DNA, 567 bp, Homo sapiens
  ENST00000572298
ctctggcgctaccatggcgtttggcaagagtcaccgggatccctacgcgacctccgtgggccacctcataggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcatcacgttgcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctct

SEQ ID NO: 22000 - DNA, 1522 bp, Homo sapiens
  ENST00000536554
ctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcag

SEQ ID NO: 22001 - DNA, 1524 bp, Homo sapiens
  ENST00000571319
ctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatggcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtcctta

SEQ ID NO: 22002 - DNA, 1849 bp, Homo sapiens
  ENST00000575333
ggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaa

SEQ ID NO: 22003 - DNA, 576 bp, Homo sapiens
  ENST00000572360
accatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcatcacgttgcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattg

SEQ ID NO: 22004 - DNA, 596 bp, Homo sapiens
  ENST00000570499
cgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagac

SEQ ID NO: 22005 - DNA, 754 bp, Homo sapiens
  ENST00000572576
caagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcaacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaat

SEQ ID NO: 22006 - DNA, 556 bp, Homo sapiens
  ENST00000573607
ttggccaactcactgtagaacctcagtcctcaaaaatgtaccttcctttcgatgccgcctggggagtggaaccaaacaggtgaaccgcgggagtcaggcatggagtgtttgggcctccacgaggagacaccagaaacttctcgaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaa

SEQ ID NO: 22007 - DNA, 708 bp, Homo sapiens
  ENST00000575909
aaaaatgtaccttcctttcgatgccgcctggggagtggaaccaaacagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgc

SEQ ID NO: 22008 - DNA, 584 bp, Homo sapiens
  ENST00000570977
gaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtgagcagatcatgtaccctctttacccctcttccatttctactttcaccaccaattactcagcattcttatcagagtgcctacaagtgacccctctttctagattctccattctcaataggaaaggtattggcatgtggggtgggacagttttcccttgtacagctcctact

SEQ ID NO: 22009 - DNA, 673 bp, Homo sapiens
  ENST00000570623
caatttctgggtgatgagttttttttaaatacttttctattttctcacagttttctctgagggtatgaatactctgtaagctggaaaaaggttattaaaagtattttactgataattgtgtgaggatgaggctgattgtcttcattcctaaatatttgtgtattaataattgttagatttttatagcattttcatatatttttttaaaaacacatgcattttgatcatttaaacaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttg

SEQ ID NO: 22010 - DNA, 537 bp, Homo sapiens
  ENST00000572905
tgtgctaggcagaacaagatgtaaaatcctttgcattctggatcagcttgggattttagaaaatccaatacaataatatttgttacccttacaacaacttcttctcatggcagggaaattctttctctctctacctaccataaatgatgctttttaatttctcttagagctaggaaatctcatgattttagggtgacagaaatatctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataatgtaagtaacaaaactcttttctagcagtgcatctagtcagc

SEQ ID NO: 22011 - DNA, 721 bp, Homo sapiens
  ENST00000574653
tctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctg

SEQ ID NO: 22012 - DNA, 552 bp, Homo sapiens
  ENST00000574318
atttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagagtatattttccagctacagacatatgtaagacgcatataaagaattgaatgggcctggcatggtggcttatgcctctaatcccaacattttgagaggctgaagtggaaggatcacttgaacctgggaggtcgaagctgcaataagccatgattgcaccactgcactccagcctgggtgacagtgaccctgtctcaaaaaaaagaaaaaagaaaaa

SEQ ID NO: 22013 - DNA, 3738 bp, Homo sapiens
  ENST00000361337
agcccaaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 22014 - DNA, 1880 bp, Homo sapiens
  ENST00000341197
agccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggc

SEQ ID NO: 22015 - DNA, 1709 bp, Homo sapiens
  ENST00000423191
agcgcgcgtgggtttcccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgc

SEQ ID NO: 22016 - DNA, 2519 bp, Homo sapiens
  ENST00000372999
cgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 22017 - DNA, 2605 bp, Homo sapiens
  ENST00000358131
accaggagctccgaacacgcaggcccaaattggaataggagatggattttgataaaagaggttaaataacaggtttttccatttcaccttatacgaatgggatggggggtgggggtgctgggcctccagccaatagaggaccaagagttgtcaggagggcttataaagcttgctatttctggcattttttcctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 22018 - DNA, 2262 bp, Homo sapiens
  ENST00000435864
gtttccaagagggaagcaggaggctggcttcacttggttcccagacatctcatgagtgccggctgcctgcccagccctctgcctggtgctgggaggcaggtgtctctgcacttgagcagatgccgggaggcaacgtgtggagagctctgccagaggcttggaaagagggtgaggccagaggatggagcaggagagggaaggcttctctgaggaggtgacatttcagatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 22019 - DNA, 1271 bp, Homo sapiens
  ENST00000413823
cgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 22020 - DNA, 3124 bp, Homo sapiens
  ENST00000407228
gaaccgacacgaggcttcacctgggaagcttcaagtctgcctacctgtgaaaggtcaggccccaacaccccttctgggaaatcctacagctaggatgcatttctctcactgaaccccatccagcagaggacagaagagtcagaagagggtagagaggatttagatactcatagaagatgtagtggaggatgaagtgccaacctcgctcgggagccaggcgcattgaggagagacttcattacctgataactacctatctgaaatttggaaataataataactatatgaatatggctgaggcgaacaatgcgttcttcgctgccagtgagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttca

SEQ ID NO: 22021 - DNA, 3414 bp, Homo sapiens
  ENST00000566696
tttgatgataatcttttcattttaaataatgtggaattttttcccctttgttcaaaaagggcactacaaagggattaggtccatcctgcttgcctttccattgatcatctttctgaacccttgtgctgtcctggtgggtttccaaactttgaagctgcctctgcgtgtctcattattgtcaccgggcatttgaaattttattccaagttcattttaaagcaaggcagtatgagaggtattcagaaattagccatgcttgtgggagatacttccttaggggcttcgtctcctctccttccccttgcaactcctccacacaaatgaagggaagaatgggttccttgggggtcgatcccccccttactccttgcatgaaactccaattaccattaaaagaagttaacttttacatatccacagaagaatagatcaactcctatgagtgataaaatagaataattgttttcaagaatgaagagtggaaagtccttgattttgtttacaaatcatgaacttatttcaggaactcattcctagaagcttgttttgttgggaaggtgcaacattagaaatttctttttagtttgcactgagtttattactgtagatagcagactgattttctgtcccagaaatataattctgagggactggaaaagtgctgcacctaacttttaaactctggagagaaagatgcatgttgactgaacacccagccatcagaccacttaggaaaaggagaagcccaaatcatgtttaatatgctggaattttatttatgtaactcagtggggtcactaatggaaatctcctagcttggatgatttctgacttttaattttgctccaaaagaaaaccaacattgaaatgctttgctcttttctcttctgtcttcatcattttacctgttgtttttatcctcttgtttggtatagtttagaaaggtatctgagggaaagaagacattgatggagaaactcattattttctctaaagtaagccatttgcagcaaagcttattcttcttgctaccttatttattgccttagcatgaggttttcagctgttctcaagaaaaagtgattctcaagtaatctgtattgcatccagaaatctttttcttatttgcaatagtaaatataaaaattgtgctccagtgagggtggcagggttctgttttgttttaatatccgtgtgtgtgtgtgtgtgtgtgtgtgtgtgtgtgtgcatgcgctaacatttaaaaatcaaagccaaggagaccaacctttttatgtgagttgtgtttatgtgacctaatttgtgcagcagctattttatagctgagaatttatacgctaaaggtggtgctaattgtggtcttttaataggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttc

SEQ ID NO: 22022 - DNA, 3233 bp, Homo sapiens
  ENST00000219746
ccgcgcccccggcgcccggcccgcgcgcagcgctgcctcggtgccccggcggggcgcgtccccccggccgcctcccgctctcccgcggctcgcgtggccgcgcctttgtgtgcggcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatt

SEQ ID NO: 22023 - DNA, 572 bp, Homo sapiens
  ENST00000563091
agcgctccgaggcagtggggacaaagaggaccggagcgggaaggggggcgagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctc

SEQ ID NO: 22024 - DNA, 548 bp, Homo sapiens
  ENST00000568436
cgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagcattttgcctgcaggctagaatctgtgttgttcattgcagtttgtgctcagccacggaaggcacctatccctagcacccaacccccatccacctagggctctataaaaagtttggaaataataataactatatgaatatggctgaggcgaacaatgcgttcttcgctgccagtgagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccct

SEQ ID NO: 22025 - DNA, 4184 bp, Homo sapiens
  ENST00000374810
acaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccagggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 22026 - DNA, 4018 bp, Homo sapiens
  ENST00000374809
cggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 22027 - DNA, 477 bp, Homo sapiens
  ENST00000451665
actcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggaggggcctggactcggtcccgcccgcctccagagcagtcccctggaggacctcctcatcgagcaccccagcatgtccgtttacgtcaccggcagcaccatagtgctagagcccgggtccccttccccgctcccggacgcgg

SEQ ID NO: 22028 - DNA, 442 bp, Homo sapiens
  ENST00000414082
tcctcccgtgacccggtagccgctgtgtcggggctgggccctggggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcct

SEQ ID NO: 22029 - DNA, 5188 bp, Homo sapiens
  ENST00000378295
tgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 22030 - DNA, 4806 bp, Homo sapiens
  ENST00000604074
tgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 22031 - DNA, 2140 bp, Homo sapiens
  ENST00000354437
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 22032 - DNA, 1668 bp, Homo sapiens
  ENST00000603362
atggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactga

SEQ ID NO: 22033 - DNA, 1623 bp, Homo sapiens
  ENST00000604479
atggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactga

SEQ ID NO: 22034 - DNA, 2117 bp, Homo sapiens
  ENST00000378285
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 22035 - DNA, 2062 bp, Homo sapiens
  ENST00000378280
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 22036 - DNA, 5120 bp, Homo sapiens
  ENST00000378288
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 22037 - DNA, 1551 bp, Homo sapiens
  ENST00000603364
aaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgtgagtcagccctagcccaccatcagtgtggggaaggaggacatggcttaaccccccaggagaaggccaggaggaccagaaacccctccagaaggcatcatctgccagggacaggcagcagggtccagagcagagcccaccccacatctcctcctccaggaagccttctagcacttggggctgccctgggaccctgggtcatggcccttgctatgcctctgccactgaggggccttgtaaatgtctgctgagtggaaaggccaggaggggtggccagagtgaccatgacccaccaagaccaga

SEQ ID NO: 22038 - DNA, 1092 bp, Homo sapiens
  ENST00000604194
aatgtgtgctggaaggtgtccaggaagccctgctaagcatctgtcagtgtctccagcacagcaggaggctgttacaggtggcgcctgattcacatctgcaggacaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacggtgagttcccctagtccctgagggctgcgggctgcgggctgcgggctggagaggaggtggctgcgttccccgcacctcaagaggtctgagctcgccccactgtctgctcggggttcccacctggcccgggccaggaggagcatcgggcaggaggcgggtctcagggccgggcagtctgggtgtgcccacccctctagacgtgagtggccagagccagtcagcctccaaagggccacagaggggacggacttggccctgctggtgagatctctgccaagactggccagcggcttccccatgctcaggtgggatctttggtttgaaatcctgtcctggacagaggcacgggctctgctgccaagagttgtctgtccgagacaggcccacagccctagggtctgcagaacctgcctcctccaggcagcgagacgcatctgcgggtgggtggatttgggctttgctggcactgtctctggagtgtcatttccaggaattggcatgcaccaaggagatggggtggaaccaccgtgccaagggctcaggtcctcactgcggtgcccctggagacagactggcccacggtggggatcttgctaattctgataacatcacctgtgcacaaggccagtctcctcgagccaggcaccatgctcagggctttgagttgagctaactcttgcacccaccaacaacgcacagggctgactccatcactgctccccttttacagccaaggaggctga

SEQ ID NO: 22039 - DNA, 1831 bp, Homo sapiens
  ENST00000378290
aaggtgtccaggaagccctgctaagcatctgtcagtgtctccagcacagcaggaggctgttacaggtggcgcctgattcacatctgcaggacaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctg

SEQ ID NO: 22040 - DNA, 1358 bp, Homo sapiens
  ENST00000604566
agcgggaacactcgctgccggcactgggtgctctgtggtgaccgagggctctcaaggccggtcctgcagggtccgaggtgggtggggaaggtgggcaggttgagggtgggcagggttgagctcacaattctggctgtgcccacccgacagtgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtg

SEQ ID NO: 22041 - DNA, 4899 bp, Homo sapiens
  ENST00000357733
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatg

SEQ ID NO: 22042 - DNA, 4854 bp, Homo sapiens
  ENST00000346387
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatg

SEQ ID NO: 22043 - DNA, 3293 bp, Homo sapiens
  ENST00000552077
ggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccggggctgcagaggagccgttccctcctgccggccccgcgtcaccctgcccctgtcgccccacagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactcta

SEQ ID NO: 22044 - DNA, 2558 bp, Homo sapiens
  ENST00000392569
ccctttcctcctttggcttaagcctttggcaggacagattttgggctggaggccagcaattcaactgggagggctctgtgccagttcttgcctttctgaagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacagg

SEQ ID NO: 22045 - DNA, 828 bp, Homo sapiens
  ENST00000552542
acatttgcccagggctctgcttgggtttggagcctttactaacgtgtgtcaataatgcgggtccaccttccataccatcttgcaaccaattatcagaaagagaaggcctgagcagggggatgtgcattttgctttctttcggcgtagcatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggcaagcggcggggcggttgctcgttgtcattctggtaggcgctggtttccggagggctccgagtgctttatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatc

SEQ ID NO: 22046 - DNA, 2296 bp, Homo sapiens
  ENST00000428632
ctttcggcgtagcatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggcaagcggcggggcggttgctcgttgtcattctggtaggcgctggtttccggagggctccgagtgctttatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccgg

SEQ ID NO: 22047 - DNA, 593 bp, Homo sapiens
  ENST00000548465
gccaaacggtgtctttttgctcttaagcctgggtgccaagtgaatctctctcctcttccaatgcagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcgg

SEQ ID NO: 22048 - DNA, 610 bp, Homo sapiens
  ENST00000546781
gcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaagtctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatc

SEQ ID NO: 22049 - DNA, 2975 bp, Homo sapiens
  ENST00000551127
cagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccggggctgcagaggagccgttccctcctgccggccccgcgtcaccctgcccctgtcgccccacagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaaggtctgtgcagggatgatgccttgggcatttgatatctgccgcctacccagctctgtctgtctgtctgggtggctgtccagccagccatcaggctgtcatttttctgctgtctggctgtccagcttatctatctggcttgtctttctagatcttgtatttgcattgattttcaaatatttaatgtcagaaaacgtaatctaactttaaaataagacagagcatgtcatagttggagaaaaatcaagaagtagagaaaggcttatgtggcagcagcagcccctgccctgcctttccctcccgtcctccagaggcttctccttcttggctatttcttctgttagtcatctccacgtttctcaataataggttcacactacggttcttgatttaaatggtgtaaatattgcttatggcacaggcgaatcgtattcctgctgcaactggatggtgctggctttagtgactgcctcactcttcccagattgcacagctttctgtgtgctgaccctcccttcttcccaaattctccatcaaaactgtctgcacttgatctcttgagcccaggaggtcaagactgcagtgagccatgatcacaccactgcactccagcctgggcagcggagtgagaccctgtctcttaaaagaaacagaaaaccctgtgcccacacttgttacctctcatcctcagatctctgtgctatcagaccatctgaccattttctctgtgcttagaggccccttcctgaaaccctctggccctgtaacagctgccagctagacctgcgctcctgacatcacagcagagggaggggaagggaaaggagggccaacgaggagagcaggacaccaatgcagtgtcggtttagagagagaaccttaagaccccctgcggaagggggcaaggaggtacgagacccagccaggttggcagctgcagccccgggcccttcccacacctgccttccatccctgcagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactct

SEQ ID NO: 22050 - DNA, 389 bp, Homo sapiens
  ENST00000546503
tctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtgtaagtgtgaaatatctccactctaggccactttccccctgagtcctttgctgttctagaagcgggagaggcaagagattggtcctagagtcctgtgtttgactttttattgtggggaa

SEQ ID NO: 22051 - DNA, 558 bp, Homo sapiens
  ENST00000550543
tttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggtgatgggcagggcagagccggagacagggagaaagagagggaggacgggaatgccccaggattgatccgggaagtgacccagaatgagccagaaggttcacaagccagagtcacagatgtcaccccctggagaatcaccatggggtcaacatccccacccctgagggtgtgcaggctgcctgtgcccttcccctcactgcaccaggtgcctctgggcagagaaacccagcccatgactcatgtgcaccccacctgaggtggcattgcaccagcgacaggagcccatatgctcaagtcacagatcacaga

SEQ ID NO: 22052 - DNA, 609 bp, Homo sapiens
  ENST00000547955
aggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtaaggggtcacctgtgagtctaccttcacagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctct

SEQ ID NO: 22053 - DNA, 565 bp, Homo sapiens
  ENST00000546907
tgtttcagacttctgtcctctctggaggtgactgatcgccttgtgaccctccctcctttctcccttgtgctccggccagcacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtaggtcccggaccacagaacgctctttgtccttcgtcttccacatcaccagctgcccctgctcttcagcctgcagcgtcagggagtggggctgggtcccatctggccggactctgttgggcgtgggctgcgcagccacggacacctacccaccctcctcccctgcctctgcccctccctccctatccctggccaggtggtgatgacgatcattgtcgcctttatcctcgaggccttcgtcttccgaatgaact

SEQ ID NO: 22054 - DNA, 312 bp, Homo sapiens
  ENST00000546787
ctcctcggatgtcaccaggctgctggagaccctctcccagatggagagataccagcaacattccatggtgtttctgggacggcgatcaaggaccaagagcgacctgagcctgaagatgtaccaggaggagatccagagatggtatcgctctgtcacctgggctggagtccagtggcgtgatcatagctcactgtagcctccaacccctgggctcaagtgatcctccccactcagcctacccaagcagctggaactacaggagtggtatgaggagcatgccagggagcaagagcagcagcgacaactcagcag

SEQ ID NO: 22055 - DNA, 5173 bp, Homo sapiens
  ENST00000541517
atggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgt

SEQ ID NO: 22056 - DNA, 544 bp, Homo sapiens
  ENST00000549279
gagctggcgcagctgccctggtggcagtggctgaagtggcggcggcttcggcggctgcggcggctgcaacagcttcgggctcggggttttggcggcggcgccggcgggctaggctgcgcgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacagatggcggcagctatgccatccacgactcccaggcc

SEQ ID NO: 22057 - DNA, 5274 bp, Homo sapiens
  ENST00000335509
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 22058 - DNA, 596 bp, Homo sapiens
  ENST00000552897
ggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaa

SEQ ID NO: 22059 - DNA, 5345 bp, Homo sapiens
  ENST00000550785
aggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 22060 - DNA, 526 bp, Homo sapiens
  ENST00000552642
gttgctaggttacccgccaatctcagaaggcgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtgg

SEQ ID NO: 22061 - DNA, 564 bp, Homo sapiens
  ENST00000547275
agaaggcgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaag

SEQ ID NO: 22062 - DNA, 762 bp, Homo sapiens
  ENST00000552985
cgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgcc

SEQ ID NO: 22063 - DNA, 527 bp, Homo sapiens
  ENST00000550873
aacgagtaaggcggggaacaagggaggagtaaggggcgtggattcttcgtcccgccccttcttaaggaggcgggcagggagtaccgcatcggcggcgggcgagacctgcggaaggacgtgatagttggccaatcagagttcatcacgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgac

SEQ ID NO: 22064 - DNA, 530 bp, Homo sapiens
  ENST00000551096
agcggggttgagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcgagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctca

SEQ ID NO: 22065 - DNA, 570 bp, Homo sapiens
  ENST00000551099
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacagatggcggcagctatgccatccacgactcccaggcc

SEQ ID NO: 22066 - DNA, 3131 bp, Homo sapiens
  ENST00000368533
cgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttaga

SEQ ID NO: 22067 - DNA, 2147 bp, Homo sapiens
  ENST00000368545
caaattgagagcaaataaggactaatacatggtgaacagttaattggaagatcctactgggtccttccacctggggtggaagacatcaaagtggctatcctgatttaagatctagtgtctggctgggtgtggtggctcaaacctgtagtcccagctacttagtatgccaaggcaggaaggttgcttgaacccaggagttggaggccagcctgggcgtcatagggagaccctgtccctaaaacaaataaatttaaaaaaaaaatctggtgtctgttttggccactttgccaatctgctagggaaccttagggcaagggtagatattaactgctctcccgtcggtaccttctgggccttgattaacaaagtcagtgctgaatgcatatgtatttgtgcttccctcttacattcccgtctgccagacataacatatcatgaccatggtggtgttctcttcccattttttgaatttttttttttcgttttgctgcttgttttcttgctgtgttcctttttgacctttctccctccccacaacctggcttgtgccatccccgtgactatcactaacagccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcag

SEQ ID NO: 22068 - DNA, 4041 bp, Homo sapiens
  ENST00000469717
gagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcgtgagtatctagctccccaaatcttgtcattaccaatttatcccttcccctttggcttgggcactaatatgaataaattagcattccttcaaccttgttaaacagggcctagggaatgggagtcatctatagtgcttttttaggcccaagaatggttttaggcttccttattctcctgactagtgacaagtgacaaaagaggctttcttattttttgttggtagggtttacaaattgagagcaaataaggactaatacatggtgaacagttaattggaagatcctactgggtccttccacctggggtggaagacatcaaagtggctatcctgatttaagatctagtgtctggctgggtgtggtggctcaaacctgtagtcccagctacttagtatgccaaggcaggaaggttgcttgaacccaggagttggaggccagcctgggcgtcatagggagaccctgtccctaaaacaaataaatttaaaaaaaaaatctggtgtctgttttggccactttgccaatctgctagggaaccttagggcaagggtagatattaactgctctcccgtcggtaccttctgggccttgattaacaaagtcagtgctgaatgcatatgtatttgtgcttccctcttacattcccgtctgccagacataacatatcatgaccatggtggtgttctcttcccattttttgaatttttttttttcgttttgctgcttgttttcttgctgtgttcctttttgacctttctccctccccacaacctggcttgtgccatccccgtgactatcactaacagccgttgccgagagatggatgagcagattagactgatggaccagaacctgaagtgtctgagtgctgctgaagaaaaggtactaaccattaagcccacagcaaggttatatatgtggtgtggttttgttttgttttgtttttgttttgcagctgcctcccctccacttgattttgttgagtgctgtctcatctcttcatggaatgctccattcttttccacttacttggcatctttcatctcttctttcctagttgcttcactgcctctccacagggtctccttcctttgggtgatttgggggactgtttgggttgggcatttgttcccacctccaccccaggtagcagttatgacttgttcctggtagtggatttctctcaagtgctttattagtattcaaacatttttgagcccaggaaggtctagctcctgacacgttctatggtagagggaggagggttgatgcttgctcaggttacttgggaacatctcttccccagtatgccttccaactctctctacatataggttcaattcacgtctatgtgtctctctccctttttttattctcttccttttcccttttcctctcctgtggtatttaaaatattcacagtaagtgttctgagctggaggaggagctgaagaatgtcaccaacaacctcaagtctcttgaggctcaggcggagaaggtaggggctggtttgtgaaagtgacaggctttggggcctgggcccagccctgcccttgatgaaagactggagacacgcattccatatataatccagtgaggcgtgtcctcttcctacctccttaccatgtattcaggttctgggtttaatgctattttctgtgcactttgattgctttaattaaaataacttcttggtctcaggttactggagtcatgtgctccttaggctgatactgctgtgctgaaaagcaataatcaagggccctaacaggctttctagcagacagatgggggcaacagacagaatcagctctgagacctaatgagcaatcaagacagatgacttcactttgccatcatgtgggtgtgtttcagtcatgtgaccttggggtgctactactcttgctcatcaagcaggggaaaggaaaaacacctccttgggttgatctgaataatatcaaagcttagatccatcttaaaaagtcatggagaattttaacctgaggatctcatggctctaaagacatagatttctgaatttcaaggacctattgtccagagccaggccttgctcttactcttggaccattcagcacatttagtgcaagaggatattcaatgtaagttaaatgtagggaggggggtattgcctgtgtgactaatttctactctgaaatttttaatctacttatcttacagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctc

SEQ ID NO: 22069 - DNA, 2108 bp, Homo sapiens
  ENST00000330188
gcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 22070 - DNA, 2063 bp, Homo sapiens
  ENST00000341485
gtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 22071 - DNA, 2007 bp, Homo sapiens
  ENST00000341372
aggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaagccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctcc

SEQ ID NO: 22072 - DNA, 1771 bp, Homo sapiens
  ENST00000328159
atggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgt

SEQ ID NO: 22073 - DNA, 1248 bp, Homo sapiens
  ENST00000509409
agttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaa

SEQ ID NO: 22074 - DNA, 1219 bp, Homo sapiens
  ENST00000271850
ctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccattt

SEQ ID NO: 22075 - DNA, 750 bp, Homo sapiens
  ENST00000312970
ccaggttctgcagcagcaggcagatgatgcagaggagcgagctgagcgcctccagcgagaagttgagggagaaaggcgggcccgggaacaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgc

SEQ ID NO: 22076 - DNA, 539 bp, Homo sapiens
  ENST00000513769
gctcatcaagcaggggaaaggaaaaacacctccttgggttgatctgaataatatcaaagcttagatccatcttaaaaagtcatggagaattttaacctgaggatctcatggctctaaagacatagatttctgaatttcaaggacctattgtccagagccaggccttgctcttactcttggaccattcagcacatttagtgcaagaggatattcaattactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaa

SEQ ID NO: 22077 - DNA, 741 bp, Homo sapiens
  ENST00000302206
ggtgagctgcatgatgtcttacatttcatgagcttcctctaaatctagttgtatttttcgtctgaggggggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgag

SEQ ID NO: 22078 - DNA, 1115 bp, Homo sapiens
  ENST00000368531
gggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaa

SEQ ID NO: 22079 - DNA, 1088 bp, Homo sapiens
  ENST00000323144
ggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcac

SEQ ID NO: 22080 - DNA, 1523 bp, Homo sapiens
  ENST00000368530
gttcccccaggagaacaatgatggggtggagggagctggaaagaccatattaggaacaaaaggtggagctatgagcacagataaagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatca

SEQ ID NO: 22081 - DNA, 870 bp, Homo sapiens
  ENST00000504663
agaagataaatatgaggaagaaatcaagattcttactgataaactcaaggaggcagagacccgtgctgagtttgctgagagatcggtagccaagctggaaaagacaattgatgacctggaaggtatggaacctggagtagggattgaaatagagaaatatagaggaagactgcccattaaccattaatctctttttctgtacaccaaaggaagttggtagtgacttggcatgtattaatatcatgtgcactgtcctatgccacagctaggcaaagtgggtcaaactctagaattggttttttaaatttaatcttttcctttaagaagactttaccaaatagtctgcaatttgtacccttcccttttgaggagaatgataatggctgcatttacctccaatttattagtcttaaacctttagtctgtgggtttaaatggaagccatgatttcagaagggcaagatgtatgtcatttcatggctactttccacagttctttttgccactcaagttgtcgggtatttatccaataaatgaagttgtggaataaccatatctgaacattgaccaatgtcaggagctttctaaatactttctgtccctgcaagttggtaactgccatccaccctgacaagggaacgtactctttgctttgagaactctgatgtatgctcctttggtacactctcttggcagagttgcaggggcagcctgtggagcagaggggccactaataggttcacattttgtaggcagagaagtgtctgaatatggatatatactctctccctttgctatttttgttcaattaagtgttatcactgctaggaattgggtacctggatgggagtggtatcctcttgagtgctt

SEQ ID NO: 22082 - DNA, 543 bp, Homo sapiens
  ENST00000509601
gtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatga

SEQ ID NO: 22083 - DNA, 540 bp, Homo sapiens
  ENST00000505010
gctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaaggtactaaccattaagcccacagcaaggttatatatgtggtgtggttttgttttgttttgtttttgttttgcagctgcctcccctccacttgattttgttgagtgctgtctcatctcttcatggaatgctccattcttttccacttac

SEQ ID NO: 22084 - DNA, 569 bp, Homo sapiens
  ENST00000368527
ataccatgccaaatagaatgagaatttgtgccatcttgcccatcccttccactccgacagttccattcattgacttccaggagacgggagagagaacctacctacctgagccgactttgaaaggagactgagtggggctcttttgaacctgaggcccagaaagtcttttagacttttcttataacttggttttggagtttgtcgtggggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatgg

SEQ ID NO: 22085 - DNA, 746 bp, Homo sapiens
  ENST00000473036
aacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcgtgagtatctagctccccaaatcttgtcattaccaatttatcccttcccctttggcttgggcactaatatgaataaattagcattccttcaaccttgttaaacagggcctagggaatgggagtcatctatagtgcttttttaggcccaagaatggttttaggcttccttattctcctgactagtgacaagtgacaaaagaggctttcttattttttgttggtagggtttacaaatt

SEQ ID NO: 22086 - DNA, 461 bp, Homo sapiens
  ENST00000466010
agcaagctgaagctgagcagaagcaggcagaagaaagaagtaaacagactgcctttgtgaccttgggaaagtcagtgagccacagtatgtctgctgaatttaagtagaaatggaccatgttttggaagaacccttgacttctagaggaaaagctggaggatgagctggcagccatgcagaagaagctgaaagggacagaggatgagctggacaagtattctgaagctttgaaggatgcccaggagaagctggaactggcagagaagaaggctgctgatctttcccaagtcagaaagtaccctcagagatatgcataagaacaagaaacaggagagggaaggttgtggccaggagcaagcaagaagaaaggtttctttcctcaaagctagagtcagcaaactaccacctgtgggttaaatcttgcaacagcctggttttgtaaataaagttttatcggaaca

SEQ ID NO: 22087 - DNA, 587 bp, Homo sapiens
  ENST00000515609
gagaaatttcccatgtgggaatccggctggatccctgtgagggaagacccttggagaacgcagcctggagttctggtaaaaagccctagaagaggagaggactcctgtggactgcaggctgcttcctggcagaagtttcctctcttaccctcagtctaaagccttagtttcaattctgccaggcaaggtggggaactataagtcttctcttctggagcccacgatggagcctgccagggagacaagttattcttctgttctggacatccaagggtgactttaaggaggatgcctggaggacatggggagaagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcag

SEQ ID NO: 22088 - DNA, 3149 bp, Homo sapiens
  ENST00000611659
gtcacatccgggcgggttggtgagttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttagacttt

SEQ ID NO: 22089 - DNA, 586 bp, Homo sapiens
  ENST00000589897
agagaaaagtgtgtgtgtgggcggtgggggaggggggaaacggggaattgctcattttacttaacaagtactttcccatttttaggggaccaggtactcagtgggccacagacaagaccaaggcagaaaagacaggcgcctccccacattgcagcaccgggaccccgagcccacccacagccctcttcattcctcccaacgatggatggggaaactgaggcagcccagagcagcccccaccctaggtcctgcccgggacacgcccacgcgggacctgtgtcaccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaa

SEQ ID NO: 22090 - DNA, 1417 bp, Homo sapiens
  ENST00000344824
ataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggacca

SEQ ID NO: 22091 - DNA, 708 bp, Homo sapiens
  ENST00000586499
gaggcggataagaaagccgctgaggacaagtgcaagcaggtgaggtgccctccgctgggccgctccgggctgctgggagtcctctctgtgcggaaggccggggtctggagcccagttgggggtcgcagacacctgcgggaggataggaggctgatgctttggcggaggaagagcgaggggaccattgccttccttggatggggtcctgggctggaagaggggtgacgatcggacccacccccagcagggccagtgcgaacaaagtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctg

SEQ ID NO: 22092 - DNA, 558 bp, Homo sapiens
  ENST00000586833
gagattgcttaactccagatcatggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaa

SEQ ID NO: 22093 - DNA, 367 bp, Homo sapiens
  ENST00000588507
gctggataaatattccgaggacctgaaggacgcgcaggagaagctggagctcacggagaagaaggcctccgacaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaaga

SEQ ID NO: 22094 - DNA, 2666 bp, Homo sapiens
  ENST00000300933
aagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaa

SEQ ID NO: 22095 - DNA, 877 bp, Homo sapiens
  ENST00000587201
agctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactgtgagtggcagaacaggactgagcgaggctggctcgattcctggggcggagtgggaaggagctggctgtgttgggaattggctctgaccggggtctctgctcaagtggacgggcgtcaggggctcatggctcatcttttctcttggcttctgtgacaaagaggtggtgacttgttcttactgccatgggaagcactgcccacgtgttgaccctttctgcaaagatatgaggaaataggagtgagacaggaggcagcagggaagcccagaagtcccattttcccagagaggatatctcagggggctgtgccatcttaacagaacactgacctgctccagaaggcaggctcccccgg

SEQ ID NO: 22096 - DNA, 563 bp, Homo sapiens
  ENST00000588410
gtgcaggctccgactccggggctggcgccggggtcccgggccgaggggaacccgcgaccggacttgtgggggagaatgaggatgaaaacgtggagcttccattgtctagggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggaga

SEQ ID NO: 22097 - DNA, 521 bp, Homo sapiens
  ENST00000590180
taggaaaaagctagcgtggcttcccttttcctctcggttgaggcccgtttgacccgttctcaatattccttccaaagagcaggcatcgctggaaaactcgccttgcctcgtagccctggcaggacctaggggacaggttctgacaaggaagagccctgggtgggtcttaagaggccattcatttcttaccaattctgagtcactgaataaaaccacttcccccagtggggcccctcggtttcttcacctgtaaaatgggtgcgatgtgtgaggatgaaattgcagtaaaataaaaccgtggcagtaagagatgcctttctctggcacatcccacctgctgggcataagcggcgccaccctctggagttacagcctcaaggcagtccggctgaaggtgatgtggccgccctcaaccgacgcatccagctcgttgaggaggagttggacagggctcaggaacgactggccacggccctgcagaagctggaggaggcagaaaaagctgcagatgagagtgagag

SEQ ID NO: 22098 - DNA, 801 bp, Homo sapiens
  ENST00000588483
gaaaatgacaaagcggggattccagcccagcactttttggccctggagttcctggtttaatgcttcccattgtacttcctttcttgtaggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggtaattgcatggccaacatttaactgagggctccatagtcttgcatttatcttgccattcaggtgaatgggagcggaactcacaggacacaatgagccgggtcactgatggccttgctttctaagaatctcacagtgagccctagaactctctacgtggtaacactgtgtgcctttttcagagaagagcctatcttagatcttagcctaacgttgggtctattgtgttgctggagagaccagcactgacattcatctcaaagcacatggctggagtgcagtggcacgatctcagctcacggcaacctccgcctcccgggttcaagtgattcttctgcctcagcctcctgagcatgtggaactacaggcacgtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagat

SEQ ID NO: 22099 - DNA, 635 bp, Homo sapiens
  ENST00000592138
tgtttttcccagacattttccgggaagatcatactgaaattttggtatgagtgtaaattccctatggcctggactcctgggtgggctttgacggggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgt

SEQ ID NO: 22100 - DNA, 712 bp, Homo sapiens
  ENST00000588032
gctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaa

SEQ ID NO: 22101 - DNA, 545 bp, Homo sapiens
  ENST00000586193
aatccactccgggcttccttcccggagtgtcccctgcaaactcccattgctctctgcccgccttctgccctcagtcccattcttacaccttccggagtcggcctcatcaatcatagatttcacaagtccttgcagccttacccttggcaaaagaccaggagtgttttccaagccctccaaatactcttcgggcgcacctcgcctctgcctggtatgataagcctttgataagcccatagtatcacactgcagaaaaatccattaacattttctccccacattccttctgccccccaccgggggagctgtgtaggtttctcctttggaaaatttattgttggggcgattgctattattgccggctgtaagggaagataagacacaaaaatcctttgtctttgtgcagaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagag

SEQ ID NO: 22102 - DNA, 653 bp, Homo sapiens
  ENST00000591645
ggtcccccaaaacactggaatcacagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaac

SEQ ID NO: 22103 - DNA, 262 bp, Homo sapiens
  ENST00000592822
aaacttctgtctgacaaactgaaagaggctgagacccgtgctgaatttgcagagagaacggttgcaaaactggaaaagacaattgatgacctggaagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcct

SEQ ID NO: 22104 - DNA, 2672 bp, Homo sapiens
  ENST00000591226
tatgaggcattttgctttcccccagcattttaatgagtcttggccttgtcccttatcagccatcacttactgcaaactaagttctctctcgtgctctgtcacgcatagctctaaatggcgtcttttttctctctctctttcttttttaatttaaattgtttcatcagctcagttacttaataacatgcctgtagaatggcttaaatttcgcatttacctggggtttgtctccgttctcctggattcatagacagttacacaattatgtgtataatttaaacagccattcccagaagctccgaaggaaagatgggttacaggattttagatttaactatcaaaggctcaggggctaattaactagcacttgggtggaaatttatattaagtcacacatatctaggactgaaatcttcatgtagcagcacgtcataggttctgaagtatttctcctttattcctcatcataacccccacaccacgcattgatatcgttacccccatttgacagacggggaaaacagacctaggaaggttagatgcttacttaagtgatacaactggagcttaagttcaggtattctgactcaagggttaccagagttcacaaggaaaaatacaggacaccaacttaaatctgagtttcagataagcaatgaataattttttaatcataagtatatctcttgcataagtacatctcatgcaacatttgggatatacttacactaaaatattatttgtggtttatctgaaattcaatttaactgggcgccctgcattttatcttacaactgtgactcccaaatttggtgcttgttccttagtattctgtgatgttctgctgtaattaaaaatacaaagtactggacaggcatggtggctataacccacctgtattcccagcactttgggaggctgagcagatgggttccttgagcccaggagctcaagaccagcctgggtaacatggtgagaccctgtctctagaaaaaatgcaaaaattggccaggtggtggcatgcacctgcagtcccagctatgcgggaggctgaggtgggaggatcacctgagcccagggaggtcaaggctacggtgattcgtgattacgccactgcacttcagcctggacaacagagtgagaccctgtctcaaaaaaaaagtactttctctcttgtgactttcaccctggcagtttcaggtttagaaatctttgggggggtgctgggcatggtggctcacacctgtaatcccagcactttaggaggccaaggtgggtggatcacttgaggtcaagagctcgagaccagcctggctaacatggtgaaaccccatctctactaaaaatacaaaaattagccgggtggtggtggcacgcgtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctc

SEQ ID NO: 22105 - DNA, 6022 bp, Homo sapiens
  ENST00000360578
gggcggtgctgggcgggacgggcgggcgcggggcggcggctggagagctccgctgagcaccgggtcgcgcgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacgccctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgcctgcttttgtgaatggtgttttgttggcacagggcctgtcctgtgttttcacacaggcctgtggctcctgctgtacaagtggagtggggaggagttgagatggagatgccttggccctggacacttacctgtccctctactggcccagctcatctcctcctgtgggcaatcacgcgtgcactggccaccctcccaccccacagcacacaccacgaggggatggcacagggggaagatgaggctggaccgtgatgttatcaataggctagaacgtccttcaaacactgaacctgcatctttcctcctcttactactgaacactttgtgagctctggtggtccagggtgcagcgtttgtccctgggcatgtgatggggagtcctgggcacatcgagatgctttacttctttctttcgacctcttaaaaaactaaaccaagccaaaccacaaaggaaatctgcacaacttaagagaaacttgaaagggatcgtgtaactactagtttgtactaagtttttttcaagaaagggaaacaaatttatatatatatatatatatatatatgtgcaatatatttttacactgtgtgattaacattagggagtactgagtgcatcactttatcagtgtgacgggtgatgtccacgtcatggctgttctgactctgaaagccacttctgctgatgtctaaaccgcactcaccgcggacgtccgcggggtggggtggccctgctgttcctcctgcaggtgagaggtgtggtgttgcctgttggacttgctgttgagcctggcttgcaaacctgtagtgaaacagctcgtgtctgtgtgcacactgctcctgtgtctgctgtcgttaacattgtgtgtcaagttggtaaagtgacaaataaaggtgttaaaacatgga

SEQ ID NO: 22106 - DNA, 4735 bp, Homo sapiens
  ENST00000530705
ggaacggagccttgtgtctccgcctcaagtccccggatgctcacctccccgactcgcccccgctgtggccccgcccccgcgcggctcttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaacaaaggtaattaagaggtgctcccactgcacttgtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataa

SEQ ID NO: 22107 - DNA, 1101 bp, Homo sapiens
  ENST00000379056
atatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtg

SEQ ID NO: 22108 - DNA, 731 bp, Homo sapiens
  ENST00000528619
aatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaattaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaa

SEQ ID NO: 22109 - DNA, 801 bp, Homo sapiens
  ENST00000529421
aactttttaatgaccccattttttgttccggccaacagacaactcttttaaatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactact

SEQ ID NO: 22110 - DNA, 794 bp, Homo sapiens
  ENST00000484604
cttttctataatatgagcatactgaagcctgcagtctgtttccgtttagaattagaatagtattttgaaaatagtcaacaagaaatgtaaacattcttgaaagataccttctgtgaactagtaatttcttaacagctggttgcctttttcagtgttttctttttttaagcttggatattttttactttaaaaattgattttactgaaaattcaatacttcaacctgttaatgaaatgttgttttagaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacag

SEQ ID NO: 22111 - DNA, 594 bp, Homo sapiens
  ENST00000533567
gtgaactattggcgtggaaggtgctttggatgcgtttgtgtcttttgcaattatactgctttttcttaatgcagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactca

SEQ ID NO: 22112 - DNA, 1851 bp, Homo sapiens
  ENST00000490277
agcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcgtaagtgatactggcagtacctagctgatgtctagaatcttacaggatttaaagattggctaacttttgaggttctttcgcagtgggtatacttttgtgaaagtccttgcttttttattaatgagttcacggaaaagagtggttgcttttctataatatgagcatactgaagcctgcagtctgtttccgtttagaattagaatagtattttgaaaatagtcaacaagaaatgtaaacattcttgaaagataccttctgtgaactagtaatttcttaacagctggttgcctttttcagtgttttctttttttaagcttggatattttttactttaaaaattgattttactgaaaattcaatacttcaacctgttaatgaaatgttgttttagaatcaaagggaaacttgaagaacagagaccagaaagagtaaaaccttttatgacaggggctgcagaacaaatcaagcacatccttgctaatttcaaaaactaccaggtaaataccttaagtatctggatcaaaggattgtacaattttaactgcaagagcaaaaattaagttgattaatcttcaattctatactagtattccaggtgtagaaagtggctttcccagctcgcaggtgtttccaaatcttgtcttctgattgaaaatttgcttcccagatgacatttctcagtttttctttttgtgaattgcttaaccacctaagtgttctttcagttttttgcttacaattttaatgtgtctcattgctactggtcctccttctaatgtatctgagcttgttaattctacttttggaaaatgtcagtggctttccctttcctctaattttccagcttcatgcatcccctggccataagatacttccagactgtatgatatattctatcactgtcagccttatgttccctgtggttgactatataagcacgctttagggtttgggattgtatttaggattgagagtaaaggtttcctgaaagcctagtgttcctggattgctctgtacgttatttttctatttaggtcactattaaggtgccttaatccagtgaacagatgtctatgataagtgagcatcagagcttttgggtactgaagttttgatttttgtggtggtctaaaccttcccttgtactgtagtttgttttgaatggcatgtatttgtatgtaatagtctaattctaggtattttgtttgcttcccaagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactca

SEQ ID NO: 22113 - DNA, 530 bp, Homo sapiens
  ENST00000530245
aatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 22114 - DNA, 764 bp, Homo sapiens
  ENST00000379060
gtttcaggctcgtgctaagctagcgccgtcgtcgtctcccttcagtcgccatcatgattatctaccgggacctcatcagccgtgaacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaa

SEQ ID NO: 22115 - DNA, 948 bp, Homo sapiens
  ENST00000379055
ccgagcgccgctccggctgcaccgcgctcgctccgagtttcaggctcgtgctaagctagcgccgtcgtcgtctcccttcagtcgccatcatgattatctaccgggacctcatcagccgtgagtcctcactgcactatccttactgccgcacacgggggtctggggtgcgggtgggggcggggaaggcgcagccgtcgcgggcctaggggacgccggcggtcttagccgagcgcggaggggtcggtgcccggggctcgcgcccagctctggtgtgctacggaggggcagatcccgcgtgcggccgccggcgcgggaaatgcgggaaatggcggcgccaggcgcacggtgatgggcggctctgtgtatccggcagacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagac

SEQ ID NO: 22116 - DNA, 1008 bp, Homo sapiens
  ENST00000309246
tcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttagatgtgatttgcaattgttttgtgacactgagaatgagttttacagcgttctgaaacatggttttagttttctctttggggatcaagagaattgtgtttcatatgtaaaaaattcttagggtataaaaaggcttagaatcttatttgtggaaaacgttgagtgcagatggggcataataaagtacagtttaggctgggtgtggtggctcacacctgtaatttcagcacttgggacgccgaggtgggtgcatcacctgaggttgggagttcgagaccagcctggccaacatggcgaaaccctatctctgctaaaaatacaaaaattagccaggcatggcagcgggcacctgtaatcccagctaatcgagagcctgaggcaggaaaatcacttaaacctgggaggggggttgcagtgagcagagatc

SEQ ID NO: 22117 - DNA, 613 bp, Homo sapiens
  ENST00000527226
ccgagcgccgctccggctgcaccgcgctcgctccgagtttcaggctcgtgctaagctagcgccgtcgtcgtctcccttcagtcgccatcatgattatctaccgggacctcatcagccgcgcacggtgatgggcggctctgtgtatccggcagacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttcttt

SEQ ID NO: 22118 - DNA, 902 bp, Homo sapiens
  ENST00000442760
cttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaaggtgagtcggtcgggcctgcgcgtgggggagtccgggccgagcgggctcgggtttcctccgctcccccgcctgaggttgtgcaatcctccccgccgcctcctggcggaggagacgctctttccgggcttgggtttttctagaaaactggaggcggagctgatcctggaaataggcccgccgcctcggcgcccatcctcctcccggggttgtccgggacatgatgcttccggcttaggagcctggagtcctttcgtgtttgtcctgtccccacttaccaaccggaggcatcacatgcccgcaactggaaacaactttttaatgaccccattttttgttccggccaacagacaactcttttaagttaggtcgttttgagaaatccacgggtcacaactttattcccaaaatggtgctttttttattttcagcaagaactaagaatacttcttatccgtgaactattggcgtggaaggtgctttggatgcgtttgtgtcttttgcaattatactgctttttcttaatgcagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcc

SEQ ID NO: 22119 - DNA, 4814 bp, Homo sapiens
  ENST00000616577
cttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaacaaaggtaattaagaggtgctcccactgcacttgtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataa

SEQ ID NO: 22120 - DNA, 2952 bp, Homo sapiens
  ENST00000453386
gtgcgggacgcgctgcagctggagaggaaaggcagagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctgg

SEQ ID NO: 22121 - DNA, 4141 bp, Homo sapiens
  ENST00000492417
attgcttacaaaatatatctgcatagtccgttagttttggaggctgagtgaaaactcctgtgatttcagaaatattgtatctgtgatctgctagattttaaggagaaaacttcattaagtcttattttctaggttaggagtactgtctcttccctcagtggacaggctgccgaagcatcttagcttagaataaaggtttttctgttaaagccaggagcttaaagaggatcttgacttgacccattcttcctttatactcagattcctgggctgactgatttctgttaactacagttactttattggtagtcttaactgttactgtgaaacacccatattctgctttcacttctggagaaaattgtttcatttccatagaggtaatctttctagtgttggagtaaacaggcttttagcaacttttgggttccccatttctatattctcacctatgttaatttttgcctgtggtaaaaatagcaaaaactacaccctcatttttgagacttcctcctttgtccatggagagaagggaagtgtccgttcagaatacttgatagggaattccaagggattgttgttaattggaagccccagagcatcactacatcctttaaccatttcttgatgttaaaggcagctgttcatatatttttcttttaatctttttacagtcagtcatggagggaggtagaggggaaaggctgtcacatttcatgtcaccccaccatgttttataatggctttgaagtcatttgaacgtttctagagtcgtctggggcctagagacctgaactcattttactggatgagttagcctttccttctgtgttaaacctcaaaccttaatttgtctattctgtgttacattataaatgttttccctgagcatcaaaggatcatccaaattttctccattatgttgtaaaccacaaaactatcttctaaagtgttttgagctgtaatttagaataatcctctactgtcctttcaagaatgtccagaatactctgaagatgtatcacacaaggaaatctcttgtgattttatctgaaagcttcacctttgattcatgccatatagtgacttactgtaatactgcttccttttgagtcttgccatttctgctctctggagtagaaaggcttaccaggctttactttgtctaagtttgataacctaaaataaaggttgccttgataattttacctagctatcagactgactaggagtaggttctgtcctttcctcatctactgttttggtgccttggcagaacttttccttggtttcattacttagtatacccttttgttgattatgtgtctttagctcgttggtgacctagttatcctggttaccattcctttgctatttttcattacaaatccccccttaacctgccagccaatcccagttttggttgggaaagctatgagtacacaatgtttacctaaactttggcttttgtatgtagtttctgtactcttttgcttcctgggccctaggttaggagctcctgatttagctgcctggttttgatgtgtacttaagtaactaggtaagttaggttaattcctggttttccataagtttgccctggctcatctccatttagctggagaagctgtggaggatctctgacaccctctctactcttatttgtgtgtagttcgctgttctgttgtagctccatctggttgctttcagttttttagggggcctcccaccatggttagatgcaatagggttttacagggtttagtgtccttcaagctagcctttgctttccactaggtttctgcttttctctaggatttgaaactgagatcatcatctttatctcttatcactgaattataagtagtaacttgaaaggtcaaggtctttttaaaaatcaagcatttttttaagtaaattatataaattatataggattttgttttattgattgcaacttgattgaaataggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaa

SEQ ID NO: 22122 - DNA, 2780 bp, Homo sapiens
  ENST00000463328
aatactgacacaatggtgtaactccttagcccatcaaaaaaaaaaacttccgactgcattactatactgtagtatagtattagtacattagttcaaaatatagttctatgctaacattaactctttccaggctgcataaacctagttagatgctctcctgactttcccatttaatttgaagctaatttcttttgggtgttgttaaggcattttttacatttcatgaaaggcttcaaatgagatgatatttattgtgatttcactgtataatccaagtggtttaggaggagggtgcagggggggacttaatgtttttagagtagagtagaatttttccctagtaaattgttagtttatgaaataaatggaatctttaggtaaattcatcacagcatctggaatgttagcaacatatggctcactctttattctttcctcttgtcatctttttttgagacagggcctcactctgtcgcccagtctggagtgcagtggtgcaatctcagcttactgcagcttctaccttgcaggcttaagcgatccgcccacctcagcctcctgagtagctaggactagaggcatgccaccacacccagtaatttgttatatttttgtagagacatggggtctcactgtgttgcccaggctagtctcaaaactcctgagcttcaagcagtccaccagccttggcctcccagagtgtttggattacaagcatgagccactgcgcctggccaactcttgtttcttacgattgcaagctgtttatgacctgtaaaatggtttggtacgcatcccctcaggcttcgtttatgtacttacttgtgtattgtgtttctgaaaaaatcgaaccatacatgctcatctttttggcaattcagagcattctattgaatggaaggtgtgtcaacattacaattttttctagctgatagacacagtgtggttccagttatccttgtatgtcatgttatgaatatgtgaatttttcttagaataaattcatagaaggaaagatgccaagttgcttttcgccagcacgagtgcttgtttacctacttaattctaaggttgaaattttttcttttgcattctttcctacccattcccaaaaatacttgtagtacttgctgtaattttgtaatttctaagcagtgtttggtctaatcattatgtacttttcttgttagtgacattttggctagtatacagctccctttttaaacaactttgattttatgacaacttttccaaagtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaag

SEQ ID NO: 22123 - DNA, 943 bp, Homo sapiens
  ENST00000259043
gtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaa

SEQ ID NO: 22124 - DNA, 710 bp, Homo sapiens
  ENST00000414862
gaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttataggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttta

SEQ ID NO: 22125 - DNA, 2414 bp, Homo sapiens
  ENST00000466832
atgatgccaaggaagtaagtaaaagcccgttcctttgtaaaccatcagttctattgttaacgccaagttatcagtgaccaattgctaggataaggacaaggacaagtcagtaatacttcgaactttttctccaacctcttgtggagactcaagatacatgcagaataacaaaattttgtataacttggggaagttggtcctaccacctgctttattagttgccacctattggggtcaactataccccaattccgccaggatatgtagtcagtgtttacactgggttcacattctagagtcaaaaataaccaaaagcaaagttatgatgcagaaggaaaacattgttccttttttggctagtgaatgatgtcatatttggattttgatttgttttgaggcagaatatagagtcaagatttgaaatgtggggctagaccccatttaagaaattcagattttaggtacattaaggatggtagctaaagtcatctccaagtatagagaagaggaagaactgagaaacacttaatgacaaacggagtttcactcttcttgcctgggctggagtgcaatggcgcgatctccggctcaccgcaacctccgcctcctgggttcaagcaattctcctgcctcagcctcctgagcaggtgggattacaggctaccacacccagctaattttgtatttttagtagagacggggtttctccatgttgggtcagggtggtctcgaactcccaacctcaggtgatctgcccccctcggcctcccaaagtgctgggggattacaggtgtgagccaccatgcgcggccgcccatttcctaattaaatttttgcagtaggatcatagctctcggaaaatagcataaattttatcttaatctctagtgccagaaactgcctgggcgtaaacactagcttgaacatctgaactagaagatagcatagtattggaattagaaacttaaattctatttaggtgaaaggatgtttcctcaaattatgaacaaactttaatgtgtttgaaacggggtatttttattttttaaatgtatgctgttaatacatactttgggaaaaggaactatatgtacttaaggctgtgcttcagtcttagcttttggcttccagagaagggctaagaaaacttccaagggttaaataatgtgttcaggtttcagtcataggatctcagtcgcaactatttaactctgttgttttaacccaacagcagccagatgaatgagttggggccctattccaataaaagattattttggggcattggaatttggattttgtgtgtttcttcacttgtcatgaaatactgtttttccccctagttatttaaatttttagcttatgggttatacagaaacagccagctggccagatttgacctacaggctatagtttgccaattgtgtgctgctttggagctggaaatactgtcaggatcatagttaggtaaaataattgtttcaagtttttatgagtagcttttacaaatgaacatttagtagagggaacaacacatttgtaagttgtagaccttacgttctggctaacattaagataacttaatgcacctaactgaaatgtccagtgggatcttactcatagccacaggataattagtggctttgttcaggatgtatgtaacaatttatttaccttttgaaggctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttt

SEQ ID NO: 22126 - DNA, 4485 bp, Homo sapiens
  ENST00000487615
agaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacggagtctgggatgtctttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaagtaagcgattttaaagtcttttgttattaaacagaaaaattcaattattgggtacctttctactcttcaaaaatactaaatgactggcttctgactagagctctcgattgaatacacgtgaagaatgcttgagaatggaaaattgcccagagttcattagtatattttacgtgagaagggaaacaattgaaactaggttccagtttgagactcggctcaagagaaatttgaaattttctgatgggttatctttttactagtaaaagtacactgtgtttttcgcaatctttgaattgtagagggaggttaacttaatgtgttaaaaattgagttttttttcttacataagagtcttcgctttctggccgagatctctaaacttttacgttgtgaaatacttccatattgttgtgtttggtgtttgcgtgtttgtgttccaattggaacctttaagggttggaatacacctgaatcaaacacgtgtctaggcttccaaagcaagcttgggaaaaccataaagctcaatggaacagcttgatcttagacatgcctgtggtgtaaatgatgcttctctggagccagaaaaatgagtgttattcaactccaggcttctgaactgggtcttaatgtaaatcactaatctcttcaaatcagtggaattctcccttatttatctgtctctaatccagacaaccccacccctctgtgccccaccttttccagtgactgtaggagtttgttgttgtgtccctcccctttaaggttgggtgtgtgggataaattattctcagtttgatcactcaatagaatacatttgggtgaatataatgacatttaaagaactggtgtgtccctcatccctcgttggtctgtgggatttattttttcccccctctcaaaggtaatagattaacactaaaatctgtctataggggtctaattagcaggcttaacctgatctggccaaaccactttcaaaagtaagatctcgttttcatctccggattcaagactcttcccccaaaattgcttgcattttgtaaaggggttgactagcaccatttctttgtaaaaagaggcactcctggcctttaagtcacaattacaagaagttgaataaaaagttgatgaagtgcagggtaatctttagagcccaataatggtcacagcgtataggttgtgtgagatttgtatgttggtcttgcacgcagtgtaatgttctgagcctctcaatattgtaatgagtttctacgagtgagtctttactaaaggaatccagaaactaaggagacactgatgtatggaccagatgttaaagaaaatgttttgacccagcagatactctgatagaatactggctattatttttgtaaagccgatgtgattgcaacataggcacgtaatctttatcattagagatgaatagcagcatctggacaccaacccatcaaactgcttttcaaattctgcagtttttctcatcttctgctgaatcttgggatgtctttttatattccttggttttagctcctaaactctaaattctaattttcaaaactgaaacatctctgaatctacttctttctaaagaattgcagccatctcaccaaatttcctttaaaaaaggattgaattgtcaaataggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttt

SEQ ID NO: 22127 - DNA, 1697 bp, Homo sapiens
  ENST00000456380
acatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttt

SEQ ID NO: 22128 - DNA, 976 bp, Homo sapiens
  ENST00000382191
agagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaa

SEQ ID NO: 22129 - DNA, 634 bp, Homo sapiens
  ENST00000465245
cggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcggtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgcca

SEQ ID NO: 22130 - DNA, 839 bp, Homo sapiens
  ENST00000485530
atttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagtatagtattagtacattagttcaaaatatagttctatgctaacattaactctttccaggctgcataaacctagttagatgctctcctgactttcccatttaatttgaa

SEQ ID NO: 22131 - DNA, 567 bp, Homo sapiens
  ENST00000493864
aagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatc

SEQ ID NO: 22132 - DNA, 530 bp, Homo sapiens
  ENST00000477939
ttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaa

SEQ ID NO: 22133 - DNA, 724 bp, Homo sapiens
  ENST00000471134
tattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaaaatgctttaatattgtggatattgtctggaactagaacgtgacattttcaagctgacattacaggtgattttataaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccg

SEQ ID NO: 22134 - DNA, 538 bp, Homo sapiens
  ENST00000480461
cggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtt

SEQ ID NO: 22135 - DNA, 288 bp, Homo sapiens
  ENST00000342294
gagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaa

SEQ ID NO: 22136 - DNA, 7034 bp, Homo sapiens
  ENST00000606738
tggagccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctgacctcggccaccccaagtggagaagccagagaaatgacacaggggtcttcggccacacccaactgctcctgccaccacctccagggggtgcccaacacgtcgagggcagtccacatgggattggctagacactctagagctttactgtacccaagttacatcttcttttttgtagaaggatcttaatttcccatagtgctatggggctcttttgtaaaatacgtgtccatattaaaaaagaaaaatgtatttattctaccgataaaactattcttatgtggcctgtgttataaccccctagccctagtgctggcccgggaggggaacccgggacatcagtgacctcctgtggactgtggctctggactggcttgctcttggatcaccgaagcctcctgggtctgggtttggcttctccgactgtggggccctcagcaggaggggcaggcaggcaggcttagcctttgtgaagctggatttgggagccagaggtgtgaacgttggccatcctcccctctgctggatgcacccgcggcctgggaagataatttaggaaagagaatgctgctattgtgaaacccctgagtgtctatctggccctccagagctcttggtaagtgttttcaaccaaagcgctggggtggggtgggaggtgggatactggtgctgaggaaagcagtccccaccccacagaacaaatgaataaactgagatccagagagaaccaggtgggtagcccaaggtcacacggcaagtgggagagtgaggacataaatccagacctctctgttctggtgtcatgaatccagcttgggttaaaggagaggctgttgaagtcctggctaaatggattgagctgggccgagggactggagtgggcacaggagggcagttttagagacaggggcttaggcctcacatgatgttaatagtaatgagagctgccatttttccaaagcctgcagcgtggcaagcactttgcacacttgcttcactgattcttgcgctagttctgtgagatgtgactatccccatttcacagatgaggaaactgagccccccaaagaggcgaagggacttgctgaagatcccccagccaggatgtggccccagatcagtgtgatgcaaaacaattcctgcctcctgttccctgttctgccacgttctctctgcaagggagcagatctcacccaaactggggccagcacaagctttcactccaccaagaaaccttttggccggctgcttatgttgacccctctggccaaagggctctggcaactgcatgtgccatgtgtcgcatgtcctgacttgccagatcttggagcccacgagaagctttcctgccaaatcaaaggctgagaggtgggcacagctgtggggcacctggggaggcacagcagccaagtggggaggcaggtgacagggactccgagagactttagcccctcggctcctcaaggtggtggttgaggagacagaggacccaggtgggctaactcccacctgggaggcctgaaaccctatggggcaggtgcctcagtaattacagagtcctggaacctgacagcagaaaggacccttcacttgatggataatagtaacagtaggaggaataataaggcccacagagaggagacacttctccaaggctgcacagccgggtgggcctgctgactcccagcccagtgcaccccaactttatagcttcgtgggtttccctggcaggcttgatggcagctaattggccccagtgccatcttgcccagcttggcagctatctcccttctgagacggcaagttctgggcagctcatgggatggtcaggagtcccacgggcatcttggcaggcagctgaattctttacagctcagccctgatggacgtgtttgagcttgagacctggcaggagactggagctctgccttagagggcccagccagccctgtgggcaccatgctctaaactgaacttgacctcaatccaggctggagttggtttatccttggcaaaaatgtgacttcctatttctgagcgggaaggggcttagctgacttataaagcaggctcagaagttggacatcaaacggatcgtgcagtgcactatttggatgagataagtgtaaaggaattagaagcacacaggccagattcctctctgtttggggcagagtatggcgtgagacgtattgagatggagcttgaggttaattaaagatgaagcatttgggtaaacagtccaggcacctgaccgtgtgcccagatctgtgccaggcactgagccaagaaggtaaattaatgcagcttgtaattactgagcacatgcaatgccaggctctgtattagagctgaatctaaccactctccttggcccagaggaactcattatcaagatgggacaagcagtgcaatgctagattacgtcgtcctggcccctaacttcaggaagattcagccttagtctttcccagatccctcctctgggcatattaggggatcctaaactctcccttaccctaattcaagtgtttaaagaaagatggctagactaaccgatggagtagacatgtacctacaggagagcaagagccaatgtggtcagacatctgttgccaaagttcactgatctctgaggaccaccagctggccagggtctgaaatgaactcaacttgctgacttatgacccaaaagacttgaggcacatatgcaggaatctgcatgtctggggcacttgaattctctcatcctgggccagagaaccaccattccataagcagcaacccacacctttgacacgatctatccaccactaactgacatttcttccagaaacgttctttgtgcccagcctcataaaatgctcctgttgctctgagaaatttgtgtgcacttcttagacttttctgtttgactgtgaggcaggcaggaaagatgaaaggtctgagacccagcaggtaaagtgatctgcttaaggtcgggcagcatgttattgtggccctgggtcctctacctctcacgaaagctgactgtgtgatgaagggctctctggggcatgttggaatggccatgtccccaggtcttcctccagtggtgggtctgatgcaccagcagccagatgaagacagggagagccctgtcatccacagtggagggagaagaatcaggctgccagggagctgcaaagggctgctgaggatgcctccagtcctgagagtcaaagatctgggatctaggaagcatggaaccttgtgctggttatgaacaaatttgtccttgcattgaaagaccctaagcatattttcttcatgctaaataatgtgttatctacaacttcctggcctcggctagacctggacaagcctaggtgctcaggccccttgtcccacttgcctaatctccagcccagggccattgtcacagtggatcccaaagaggagggaaagtccttctaccaaaaggaaagtctattgaaaatgctgtgaaggacaagagaagttctccagggaattgcagctttgatggcatcctgtgtggcagacagcagaattggggctggtgatagtttttcagtgactgtgagataagaaccagagtcctcagcctcaccctgaagtgtccgctagacccttcgtgacccaaccctgctgaccagccacgtctctcatgtctcttaccctgtgcctggccagcgtgatgtgcagtcatctctagaatagacaggatgtttcacacatgctgctccctacccctggaaactcccttctctcccctgtaactgctcatccattgaggatcaacacagatagcacttcctccaggaagccccctcccattcctttgtgctttcttagcatctatcacaatacccactgcccagtgttgtgactatctagtgtgtatctgctcctctcggactgtgagcagcttaatggcaggggtcatgtaaatttgtttttgtaccctcatctgacacaaaggtggtgctcaacagatgtgtagagagagaaaggaagggaaggaagctgaaggaaggggaggaagaaaggaatgaaggcagaaaagaaggagagaggcagaccttagttccaccagtggcataatttccaccaagccaaagctgtctggggatggcccggagcccccaagggtggcaggtttcccatcgggagaggtgtttgagcaggggcagtgtgcccactggctgaagaagtggtaggagagttgacatcttgccaagggcctggtgtagatgacattgagggtccctcctggctctgcaatgatcaagttctatgaacattgttatttttccagaaattcatctgagcagccaaaaaaaatcaccccgctggctgtctaaaccagtaaggttcaggaataagtccagcctccccactccacccacaaccaccaccacccctcacagcgcccccttcaatgacccagctgggcttgactgctgcctttgggtgggggaacttctgaaaggtggaggaggagtgaactggaacccaggcctgcagcccagcccagagctccttcccgctctgccccactccctgaccccaggggaggaaagggttcacgagaactgattgaccccctacttggctctttccagggagcatcggctatcctcaccctttctccaagtgggagctgggctcttcctttccggagatactctggatactccttcactttgctggatgaccttgggcaagttcctgtccctctctgagccttcacttcctcatctgtcaaatgaagaccttgattcctgcctgggcagttctagggctggagggcaggggtgacatggacaatcttgggcctccatggagatgaggtgcttggctttcttcccaggacccacaggctgccatgggattgaaagcatgtggaggtgggaaaggtgacagagtagcatgcctccaaggcccccttcatcccagtcctgctgtggggaaagtgggctttgaacgggatccaagtctaagatgtttccggtgagctgccagggacaaagggctctcagacatcttgggtccccagtggctggggtgggcaggggctgattcagccaaaggaggctctagcccagaacagaggaagccagagcccctgccccattcttgagcctcacagagcttgtccccgagttgattcactgtgcaacacaggcttcagattcatgtatttgaaaggtattcatgatgttgttctcttatcacctctgcccctcacctctgtgaattatcatgaagagtcctttaagagtataaatagaagacaaagaaagatgctattaatgttattttgccaaaaatatttttgtagcataatatattaataaaagatattatgaattcaa

SEQ ID NO: 22137 - DNA, 619 bp, Homo sapiens
  ENST00000435576
ccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtgg

SEQ ID NO: 22138 - DNA, 6324 bp, Homo sapiens
  ENST00000373887
gcggcgggggctgtgctggcgccggcaggcgcgaggaatcacagagcggggcgcccagcctcatcatggggcggcccacggagacttcccgtgggagtggggtctggtgcaggggcgccccaaaggacgagtgggagatggggacacgcggcgcagagagactcctcgtggatggagccgatggaggcccagtgtagaagagaaaggggtcaaggagacggataaggagccaccagagacgcggggggaattccccgcagaggatgcgggaagccggggaaaggaagggattccggaaggaagggctgagagccgggtcaggtgctggcaggagggctggttggatagaaactggggcgggcccagggcatttggcgtccccgacatgcgtatacacttggagagatgattccctggagatccaagtgcctgtatagacaatcttttctagaagttctaccgttaggtgaggcgagagtagatgtagaaattggagacgagaataaagagtgttttaaaagcgtgcgtggttacaggactggctctgggttcaggggtccccactcactagctgtgagaccttgaacaagtcgcttagcctctctgtgcctcagttttctcatctgtaaggtggggatgatgatggcaatacctgcttcacagagtgaaaattagatgagatgatgtctgtaaaattacgtaagacggtacccaaaagtagtactatttttcccttttcttattagagcaggttgcgcacgttttgatgtccgtgggaatgagcaggtagagagggtggtattgaggccggaggggagagaagggacccacagatggggagagaagtcttgggtgcctgttttatcccaaaccaggggaaggagggaacaggtagggctggctgcaggaaagcttgcaggtatggggtacacagttaaaagggagtgtcttctgatagtcttgatgcaggcctggaggtcgtttgttatgggggtggaggtcctgatgtacattgtggcggtaagatgccgtgctgtctttgccaccagcctgtggcagccctggtgttacaccagggcaggtgggcagtttaatgtatctcaggccagatgacctgccctgcccacctgttgaggctccagtagatagacgtgaaagcacagtataagcataatgcaccactttaatccttttctctgaggagctggaaggcctgtagtcaccatctgagccaaatgtcattcaagtacttcacttgggttacacaccacactttgacccactatctcatttagtcatcacaacaaatgggtgaaataggtattattgtcccattttacagatgcagaatctgagtttcagggaagttaaggactttgtcccagggcccacagttagtaagcagtggacccaggatttcaactcagctctgtctgacctcaaaacccatgatctgaaaccactgtgaaagtttgcaaaacctctgtagcagccaagcaggatggaaagatgtgtagggattgtcttctccatttgatagatgagacaagagctgggtactctgatctccatcccaagcacacagagcttggggccccacagccctggtgtgaatcccactccactaccagaggctgtgtgcctttggaccaggcatcttgcttctctgaccctatatacagctgcagaagaattccttgcaggttgctgtaaggatttggagggaaactgttgcccagcacacagtacacattctgggagccatcgtttccccagtgcacttttcctgcaaatgtggatctacatcccacttggatgctgagaccagctgctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 22139 - DNA, 3715 bp, Homo sapiens
  ENST00000546084
gatgattacggagctgtgtggactgtgccctgacaggagaaatagcagtgctgcccaggatcacagctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 22140 - DNA, 4303 bp, Homo sapiens
  ENST00000540010
acactccaccggaagctccgggcctggccgccggtaggcggtggcggaggcggcgccgagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 22141 - DNA, 2923 bp, Homo sapiens
  ENST00000262395
cacagccgagccctggccgcgaccgccagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcaca

SEQ ID NO: 22142 - DNA, 718 bp, Homo sapiens
  ENST00000478021
gccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagatcatgaaacgagattcaaagaaaggctgcgacttgcccagggtcacatagttacttaaaggcttaactaggatttaaacccggactgcttatgatcacacaatggaggaaggactgaatcctcccccgaagaaggacccctctaggcggctcccctctctcccgggggctggagtaaggcgggtggtccataagtcatgaagaagggggtcgcactcgtgttgttactgaactcccgctgccctctcaggacgcagcctgggccggctcctgccctcacatatgctccggcacaagctgcaggactgccccctccccctcggcagtgtacacatttactctcctacagacacagccccattgtctccgccactgctcttccccggccctctgggttccagatgaggccagctgagccccccgacccccccacagctgacccaccctgactgcctcgggaaaggagcgggggagggggcc

SEQ ID NO: 22143 - DNA, 787 bp, Homo sapiens
  ENST00000461195
ccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccag

SEQ ID NO: 22144 - DNA, 748 bp, Homo sapiens
  ENST00000498540
ccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaaggtagcctgttccctcccaccaggccagtttgcaaacgaggcccctgtttgccctggagggcatgcacaatgcccagcctgtaggggtgcacagagctgctctgtgcccgcaagaagtgttccctccccttccggtggcaagccagacctgtggctgagggccagtatccctccaccaggggaaaggaagcagagccccagggacagcctgggattgagcaggctgattggctgcctcttcaaaggaagcgtcctgtgcaggcatgttaggacccagcatcagagcagatgctgcctgctgtgcccttcatccctggactcaagaggggcaaagagcccaag

SEQ ID NO: 22145 - DNA, 631 bp, Homo sapiens
  ENST00000422344
cgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagttcccccatccctacccccagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgat

SEQ ID NO: 22146 - DNA, 789 bp, Homo sapiens
  ENST00000586813
cgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctg

SEQ ID NO: 22147 - DNA, 1456 bp, Homo sapiens
  ENST00000444415
gctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagca

SEQ ID NO: 22148 - DNA, 702 bp, Homo sapiens
  ENST00000394925
gggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaaggtagcctgttccctcccaccaggccagtttgcaaacgaggcccctgtttgccctggagggcatgcacaatgcccagcctgtaggggtgcacagagctgctctgtgcccgcaagaagtgttccctccccttccggtggcaagccagacctgtggctgagggccagtatccctccaccaggggaaaggaagcagagccccagggacagcctgggattgagcaggctgattggctgcctcttcaaaggaagcgtcctgtgcaggcatgttaggacccagcatcagagcagatgctgcctgctgtgcccttcatccctggactcaa

SEQ ID NO: 22149 - DNA, 683 bp, Homo sapiens
  ENST00000262396
gctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttgg

SEQ ID NO: 22150 - DNA, 544 bp, Homo sapiens
  ENST00000475329
tttctgcgatacctgcctgcaggagttcctcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgat

SEQ ID NO: 22151 - DNA, 825 bp, Homo sapiens
  ENST00000584944
gtggccgcaagctgacctttgccctggttcttggcagaggaccttcctggggactgggcagccttcgcacttaatctcagcccatccctgttccccctcccagtcagctttcagcgcagccaatgaaaactaacctagggggagggggtgactgtgcagcgtgttcctttcccagtccagctgccatcctgggggagggggtgccagctgccacctgttggccaagtcctgactgaggcagctgtctgtgcctcctctaggcccagaccccccttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctac

SEQ ID NO: 22152 - DNA, 585 bp, Homo sapiens
  ENST00000473421
ttcccaggacaggggctggggtcttctgggatcctggggaagtagagcccctcaggcctctgcttgcccttttgtctcatctaggctggttgggaaccggtctgtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccag

SEQ ID NO: 22153 - DNA, 672 bp, Homo sapiens
  ENST00000454852
gaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaaagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagcc

SEQ ID NO: 22154 - DNA, 484 bp, Homo sapiens
  ENST00000578917
agagccccagggacagcctgggattgagcaggctgattggctgcctcttcaaaggaagcgtcctgtgcaggcatgttaggacccagcatcagagcagatgctgcctgctgtgcccttcatccctggactcaagaggggcaaagagcccaagagaggctattacaggctccaagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctg

SEQ ID NO: 22155 - DNA, 788 bp, Homo sapiens
  ENST00000469529
aagagaggctattacaggctccaaggtagagccagcccagttgggtctaggggtgggaactgggcactgcagtcagctctgaccctggccagttcccccatccctacccccagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcag

SEQ ID NO: 22156 - DNA, 449 bp, Homo sapiens
  ENST00000580073
gcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgcccttgaagccctagacagaggctcagcttctgatgtactta

SEQ ID NO: 22157 - DNA, 543 bp, Homo sapiens
  ENST00000618771
accgccagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctga

SEQ ID NO: 22158 - DNA, 4958 bp, Homo sapiens
  ENST00000462410
agacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggttggtattactcatgaacgatatctgcttttgccatttttccaggaatgtgtgttgaacccctttatgtgacagttactgagctaagcatggtacagggattcagtgaattgccctcaaggattcccagtctagcaatacaggtggctacagtgctgtagcccacctacggctgaggtgtgagtgaagaggttcgtcctgtatggagcgcatggaggacatcttgtatccactagaccttaattgtgtggtagggatcattgagccaaaagagagggcgtgggacatgctggacaaaacaaacactcaagaatatgccattttgggggaactgtgtgggacccagggcatgactacagaaagacacaattgtgaggtccttccccaaaagcatttgctctctcacttggtgctgtcgtaggtgtttcccagcaactgtgggacctggcctcatggggtttatgatctaacggagatcactcagaccaggacagagacaggctgtgggttaaaggtgaagcattgataggagagacaaaccaacaaggtgtaggggaaatgtgagtgaaggggaattgatgcctttcaaatgaagtgaccccagctgctcttccttccagctagggaaggtggttaaaggggaagctggaagtgtggcgctgcctggcaggcccatgtcaagtttgatcacactgcaagtgaacatgactcaggcttctctaacttctagggaattgctgagaggctgctgaaatttctcccgcacacccacacattttggaacacatatttcagatgattcagtcttttctctatcacacctccaaatccctcagggactgagcttataaatgtgtaaatgatttccttgttaatccaggaatttatttggaggttcatagaacttttgttatgttttcatgtgtcttttgccccttgttttgaatagtcgagtcctagagcaaggccttttttccaactttgttgtcactaagcctaaaaagtaagtgaggctcaaatggaccattgaacagctttagtgaccaaaactggcttatggagagcagggcctgggttctctccacctgtttcttttatatttcccctcattccttgtttcccacccacccacttctatggtaaggtgtagaatcttacaggtagcagagttttgatgaatgttgactgtttgggtgagagttgaggagtaatatcaaccaattttggagaagagatggattccaactgtgatcaccatatgattcttactaccagaggtgaaggagaatagctgcatttgtttatctcactgtcaaaaaactgtttgctttttcttctgagaagggatcagcaaactctcttaagagtcaaacaataataataataatcatcatcataatcataaaagagccagatagtaactattttaggctttgcaggccatacagtctctgtcacaattactcagctctcccattttagaggcaaagcagctatagacaatatgtgaaggaataggtgtggctcctctccaataaaactttaattataaaaacaagtagcaggccagatttggcctgtgagtcttagcttgccaattttgtcttaaaggaccctcagggggacaagttctctaacattttgttaacttgccagcatcacaataactgcagtgattcaaaggttttcactgagatatgcctgcttttaaacctctagaatgttggccaggcgtggtggttcatgcctgtaataccagcactttgggaggccgaggtgggcagattactggagatcaggagtttgagaccagcctggccaatgtggcaaaaccctgtctttactaataatacaaaaattagccgggcatggtagctggtgtctgtaatcccagctacttgggaggctgaggcaggagaatcgcttgaaacctgggaggcggaggttgcagtgagccaagattgcgccactgcacttcagcctgggtgacggtgcgagactctgtctaaaaaaaaaaaaaaacaaaaaaaaacctagaatgtccagcctggccaacatggtgaaaccctgtctctactaaaaatacaaaaattagctgggtgtggtgcacacctgtaatcccagctaatctggaggctgaggcacaagaagctcttcaacccaggaggtggaggttgcagtgaacggagattgcgccacttcactccagcttgggtgacagagagagaccctgactcaaaaataaaattaaaaaaaataaaatagaatgtgaagaaccctggaatgaacactgtccatgtaatcattctctaatattaaataatattaaatagtatatatagttatatattacatataatatattaaatactataatatattgtttataataaatacattattgacatgtaaataaatgtttatttttaataataaataacagaatatttaaaataacttttaaaataaaattagagaatatttaaaataaaatttaaataacttattatttgtgttacctaggctggagcgcagtggcacaatcatagctcactgcagcctcaaacttctggactcaactgatcctcccacctcagcctcctgtgtagttgggaccataggtgtacaccgcaacacttggctaattaaaaaaaaaaaattgtggagacaaggtattggggtctcactgtgttgcccaggctggacttgagtcctggccttaagtgatcctcccatctcagcctcccaaatttctgggattacaagcatgagccaccacacgtggccaataaagtattattaatggttaaaaatatttcctgactttaccagtctgaccattcctagcttctcttgggcttgcacacctatatttcctctgcctccttttctttatcatttctggaatagcttactgtcccttcttttcatcttcttaatcctttccctttcttccttgagttaggatatgcccttctctccttttttccttttcctgtgtccttttaccatctgctatgcagagacccatacctgatgctggaggttgggatgaagagtccacaaaagaaataaaaatgtccttgaagaactggtaaattaaggaaaatatccaagaactaacctgagaatatgagcacattattagatcatctaaaacaaacttggtgtacttccctcttcacctatcttcccctgtcctctgaatttcccccagccaagactggctttcccatctctggtacaagcagccctccccatgccctctcctcagcagagacagtgggcagcatcccctgagagcctaccctctgccttgccctgtgcaagcctttctgcccagctgcccaccctgttctctctccctccctaggccttccagctgacttctttcctaccaccctggtcagcaggtcccactggcctgttgttatctgttgcaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacaggtgaaaaacaacacatacaacagtcatctttatggagctaaattatgcctgagtggtcacagtgaatcaggtggaatgccagaagaacattcctgcatttatttttgtacagaattaggtctaaagaatttgctttttggagagaagttctgtgaaaagcttaaaaccttcttgttggtagcactccatttattattggcaaaaatattatttgaacacatgctgtgtatgtgtaatgaatgctgggtgctgagtcacaaggaggtgacaataatgtctactctctgaattctgcagtgtagctggggaggcaggatgcaggcataaaaagaaagcatgggtaccttttacatgtcccgaaggagctatgctggcagttccccaatctaccttctttgaatcctgtgttctatgactttcttttggaataattggaaaatttaatattttaattaagttcatttacacctagaaagtggacatctttaatccttttttggaattaggcaataacttcctgtagagagtaagccacgtgacatataatccccaaagagacacaggtgtaatcactgtgaggccatgaaagacaaccctttgttttattgcactttctctatttcagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacaggtaaatcttcaaaggttcaaataaaaagtgaggcaacagaa

SEQ ID NO: 22159 - DNA, 905 bp, Homo sapiens
  ENST00000488428
gatgacggtctcagcctcctcccgaccccttcctgcgcgtccgctcttcccctgcgcccgcccgcgcccctccgcccgcgccccggccccgccccaggcctcgcctccgcttcgccgccgccgccggccgcagccaggagcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggtcccactggcctgttgttatctgttgcaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatg

SEQ ID NO: 22160 - DNA, 437 bp, Homo sapiens
  ENST00000494355
aggagcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgaggtgagtgggcagggcctgcaactctggccatggcagtcctagcatccaggtggcaactgtggccactcaactgttttcatgggttttggagttgttttacttggccacagaaccatgactgtaaggaaggactctcccagatcccctctgtgagggcctga

SEQ ID NO: 22161 - DNA, 3972 bp, Homo sapiens
  ENST00000261464
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 22162 - DNA, 1827 bp, Homo sapiens
  ENST00000367004
agtgcagggatgtgcagatgagtgggctgtggggtgtcctgctcacggtttcatggatgaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaa

SEQ ID NO: 22163 - DNA, 3491 bp, Homo sapiens
  ENST00000473385
tttgtcattattacttttgctactgtgcatgtaacatttaatgtggtatggtgatcagtactctttggtggtagttttattttgttttaagagacaaggtgtcactatgttgcccaggctagactcaatctcctggactcaagtgatcctccccatcagcttcccaggtacctgagattacaggggcctggcttctgtggttgcttaataagtccatgttgaatgaatgaagagaaccagttcagtaaattcagtcaggtgatgtctgtcattaggtgaaccatcatagtaggttaggtatagaaaaggctgatgagaaattctgtagatgtggctttttggaaccacctgtgaatatcttcctataattatgtaggaatctaccctgtaaatattttcctagaaataaatatgtagattttttcctagaaatactttcttagctgcaagtgcatgcatattttaactatatgcatgcagttatattcagtgactttatttttcctcacgttcctgttattagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtc

SEQ ID NO: 22164 - DNA, 3972 bp, Homo sapiens
  ENST00000336184
agacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttc

SEQ ID NO: 22165 - DNA, 4770 bp, Homo sapiens
  ENST00000334268
ctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaa

SEQ ID NO: 22166 - DNA, 1661 bp, Homo sapiens
  ENST00000628709
gaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggacaaagcccagccattccacctcccttaccgacagaacaagcttccagacccactccggcatcacctgcccttgaaggcaagtacttttttttttcttaaagatctctattgtagataaaatagaatgtagaggaacagcaacaacaaaaatagtcacaaagaaacagcaaaatccaatattttcttaaatacttttagtatgtctaaactatacttttcctaaaattgcaatttgcttcttttagaaaaccaaaaatgtccccttaagattctatattggtgaccctcagcttccagaaggatgcccactctagcactttgggaatcaagcaaaaaaatatagggacaaatagataaggctatgccttgcaactctgggagttttaccacaacttgatcaatttagtctctgaagaggctggtgccagatttgctgggtttgaatctgagctccaccttttcctagctttgtaaatttggaaagttatttaaattaactcttcatgagttttgccatctctaagatgatataagcagagcactgatctcctagcgttattgtgaggattgaaatatatatatacacacacactcacacacacacaaatactgttttatgtatatgtatagtttataagtactatatacaactggtggttaatactactaataattcttgaaaatatgatgtctcaagatcagctttgtaataaattttgctggaacgttaaa

SEQ ID NO: 22167 - DNA, 766 bp, Homo sapiens
  ENST00000361029
ttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcctaaa

SEQ ID NO: 22168 - DNA, 1294 bp, Homo sapiens
  ENST00000542443
gtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaa

SEQ ID NO: 22169 - DNA, 776 bp, Homo sapiens
  ENST00000422596
aaatacacaaagataagactgaaaaacaagagaaacctgaaaggaaaatacaaactaaagattggtcagccaattcttcaacaatcagaacattgaagctcactcagttgaaacctatttatatttgtacttaggaaactaatgtctccttactgttctctttccttttttcggttcttaattcctttgatcacagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaa

SEQ ID NO: 22170 - DNA, 1179 bp, Homo sapiens
  ENST00000546248
ctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggtaaacattcagagcaggaggctgccggaggttctaagagaatattgggcaagaagcacatgcagtga

SEQ ID NO: 22171 - DNA, 2771 bp, Homo sapiens
  ENST00000264029
gccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagttcctgccttcccctgcctcttcatgccctcctacctcccagcctgtcctcagagcgaagtggagggcagggtcacgacctggaggtcatgggtaggggcctagctccctcctggaaccttgaatagggtggaaatcctgctctggagggaagacctatccccaagtgcctcagcgccaagccccacaccggccttccactcacttccgtagtccaaaggctttattgttctgctgaaatgcttacaaatactgaaaacccccagcctgggcccaggcaaccaagggctcaatgctgggaaggagagcaggggaggtgggcttagtgttaaggcgtgaagggcgaggccagacagctggaggcctggtcctccactctccatttccatcacccttcggaggctgaaggaagggcggcggcaccacagggcccttcccctctgctgcatcatctcctgctcaggctttctctctaggagcattggaggaatcctctttccctgtcggaaactcaacactgtacagaactccaaccataacccttctagcttcctctcccaactgcatcgctcctcctctgttccatagatcccccggcttcatcccttctggctctaagcaaggcaccagtggaagggagagggctggactggggggctggcagcctgtgcatcagggctgaagacacaggcagggggaaggaaaaaggtattcagtcccttccccccagcatgagatgcccaggggcctgggctggagagatgatggcacgtaccctcagatggcccacagctgaagcagtgggctgggccacagagctgcagcaattagtatgtaaccatggcaatgaagcagtcactatggtaaccatggtgatgagtctgcaactaggggatggagctgggacctcaaggttga

SEQ ID NO: 22172 - DNA, 1723 bp, Homo sapiens
  ENST00000613915
attcagtcacagtcacagccaccatgccagggaggacctgggagctgtgcctgctactgctgctggggctgggactggggtcccaggaggccctacccccaccctgtgagagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaaggtatcagcgtcctgggcctgcccaaggcctgaccaagggaactgaagagaggaatgtgcctggggcccacagtgtcttcggagcacagatcagggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagt

SEQ ID NO: 22173 - DNA, 1718 bp, Homo sapiens
  ENST00000397925
gtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacct

SEQ ID NO: 22174 - DNA, 1521 bp, Homo sapiens
  ENST00000531295
agtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggtgaggaactgggcagcccacccctcaatctcttacctgctcactctggttagagcatcacaatgccccgggcaggaggaggagtgacttagcctggcctctcagatggtgacaccgagagccctctgcaatcctgggctgtggggcccaagggcagctggatcaagatggctcagcctcttcttgaccacagaggggcttagtagctactagtgccaggctgcccacctctcctctttgccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactc

SEQ ID NO: 22175 - DNA, 535 bp, Homo sapiens
  ENST00000527558
caggctgtgcccagcaagccgaaggtgcctgggcttgctcattcagtcacagtcacagccaccatgccagggaggacctgggagctgtgcctgctactgctgctggggctgggactggggtcccaggaggccctacccccaccctgtgagagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaaggtatcagcgtcctgggcctgcccaaggcctgaccaagggaactgaagagaggaatgtgcctggggcccacagtgtcttcggagcacagatcaggtttcctttcctgagaaaccagtccctggcccctgggtccccaaatagaggccctct

SEQ ID NO: 22176 - DNA, 1012 bp, Homo sapiens
  ENST00000373122
ccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggccatctcaaggctcccatctgccttcttgtctctccaaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggata

SEQ ID NO: 22177 - DNA, 1044 bp, Homo sapiens
  ENST00000373113
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 22178 - DNA, 860 bp, Homo sapiens
  ENST00000338469
gggcagcgcctgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 22179 - DNA, 590 bp, Homo sapiens
  ENST00000548156
agaagagaaggcattcctgacccaaagagcatcagaagaaaagtccatataaacttgcttaccttatcacattagagcctgtttgtttgctgcaggagaaagcaaagggcaagataaaacctgaagacacagaagaaagatgggatcaataatagaacatggcttggtgaagagaagagaaactgaggcacaagtgttatgtggtcaagatcatacagctaataggtggcagtctgactccaagtctgtgcttttcactgctgtgctatgccactaaaggtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtg

SEQ ID NO: 22180 - DNA, 10733 bp, Homo sapiens
  ENST00000261180
aagaaaaagaagaagaaaaagaagaggaagaagaagaaggaggaggaggaggaggaggagggggccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacgtgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagttctcctgtgtcagtcttgcctatagattttgccatcgttttctgtcaaagttccttttgcatgaaacaattatgcaaacttataattattagtgctgaaaaagagtttattttccatcttgtttgttttcctaccttatgctgagtagtccagagagttaaaaaaattctctgcatgttggtcttttaagtctgttttgctctaatcctccattaagcgagcatacctcaagtgggtctattagcatttaatgaccttttgtgccagttgtgccatcccttaagatgaaaagttccttttcttgtgttaatgtacaaagcttttcttttggcactgacaactgtgttctacctgggaattttgaatagccattttcatggctgtgtgttgtgtaacacaaatgtttttaaatggtattctcacccagtaggccagctctccaaacgttgcttagatgcttcaaaattagcatattttaagtttaccagtataaaataccaatgcaactactctacatagccaaatgtttgtaaatcacgtcttattttcctgaggtttttcactccaccaaatcttacaaatcattgaaagaaatatattctaacagtacgcactgaatagtgaaaataattagacattttaagaaccagagccatagaattattttaaattagtagaaaagaggagctatttccgaatctatagaataaagtaccacctaaaactgaattttatcatataagcaagtaatacctattagtcatacctaaatttttcagcacttcattcaattaaaatacatgaattttaaatattttacatgatgtgaataggcatgataatacttttagtataaaatctaaactttttccatttatcagaaatgataaaatccagttaccacatatcacgtttataaaatccttaattaaatgagtaacttctaaaatataacaatactaaatatcacactgcgatggaggtcccaaatatgtggtctatcaccactgaattcatgtaatagataagaaaaaaattagaggtggatgtcttgttttgtgtcatgaattactaaaatctcttagtagttgtggtatatttttgagtaaaattaccatttccagatttgagtttgaagggcttttatagttgtattttcctcctcactgttaataatcataatcctttttcagtattttagtggccttgaacaactggtttatctacaatctcaaatcctaagtgtataattatgtgcaatgttcaatacctcatataatacttgctcaacagtatagtggtaccaatggcattaagatggtgtttttgttctacatatttttcaataatttattctttctaatgttgaaattatatcaggctttaccggtttttttagttgtttaaataagtaatattttcaaaagaataaaataaccaatgatatctcttggaataatctgtaaaacgtagttataaaattctattttctacttagagtttttatcttttcttttttgtcggctttacaaattatatgtatgcatgaaataactaactgttgaaagtgtccaacctccagccatagcaatttgctgtgccaatatgtgtacaaaaaagtagtttcaattagaaaggacaacattatttatcacattgagtattaaacatttccaggtaactcgtaaataaaaagatttccccatttttacacattttttcttaaaatttttctataatctttgaagtttctaaaatacacaatctcaacctctaagactaacatctacaatactaggtctattcttgagtttcaataacatgtattttagttgggtcataaacttgcattattttatattatctccaggacaattatatcataggactaagatttttgtgatagtattatttacaaatattataagtataatatcttgtgaggctattattaaggttatgccatgtattgataaaatgcattgctttctcaaagaactgttacacattttgttttatttgactcatcacaaaaacataataaatgttgtgagccctaatattctgatgagaaaactggggctcaggtagcaacatgagctatttaaaactacaaaatagggctgggcacagtggctcatgcctgtaatcccagcactttgggaggctgagggtgggaggatcacttgagcccaggggtttgagaccagtctgggaaacatattgaggccccatttctataaaaataaaaatgaaaactagccaggcatggtggtgtgcacctgttgtcccagctactggggaggctgaggtgggagaattatttaagtccaaaagttcagtgctctagtgagctatgatcactgtactccagcctgggtgacagagtgagatcctgtctctaaaaaaataaaataaaatcacaatgtttgttgttattttgggaaccaatataacaacctaagtctatcacaacatcattccccaactaaaatataaatatatgttgaaaatatctctatcgattgcattaattggagattttccaaatactagaccagcatcaaaatacacagttaaatatatttgcaataattccattgtttgttaacttttgcatttctaatttgcaggatgttaaacaactggatgaaatgttatgatttaatttggtcagtataaataatcaaatattgggacaaataatttaattcatttagtttattaattatatttcctgtctgtatcttttattgaacattgtttaaacataaccttaaagtactgataatttgcttaattttcaacacaaatttatctgacaaattctgtctatagtaacagatggtcagaatgcagataaattgtgtgcatctcaatcagtaaaaataatattcagtaaaatgtctataaatctatgcagattaagttgtgaaaaacaatgcaattttagtactactggattagatgcagtaaaggaatccctaaggaagtttacaataatatatttaattaaaatctactggcaattagaattttaaggaattcttttctaagaagttggagaacctaaaatagcttgcttattcgcctgggtactctcatgaagtaaccatgtacacctaataaagaaatagtaaaagcacatataatgaaaaataattaagatttcttacacctgattttttcattatcagagataattatcagagataatttttcattatcagagatcatagctgaattatcatttgacaatacataagaatatatattgtatagatacaatatataactatacttaaagaaatatttattgagcatcttttatttcacaaggcacttagtgagggaaaggaatacagagatgaatatggcctgaaggaatgaactcatattacaataaatgaaaaagaaaaagaaataatgaaccaagggaatgagggcaacaggaaaaataattccttgctacagacgggaagtcaatcatttttaggtatacataatattatacaactatttttgtacactagttctcaaaacatttatgatacctagtataatttttattgtttgatttcctagtgcttacttgtgttttacagaaatatgttacattttgaaattataataaaataatagagtttaaactctaataattggaatataaattgggatggaatttatccttaagaaaagctgtttaaacaatttagtagtattagtaagttgcaggaatactttaatctacttacgaaaaagtagttcaagttttctaaaatggtttcagcatactatcggtatctcacaatgtgttaattttaagttaattatatattctttaaagcagattaaataatacttgtcctaagcataatttatttgttgaaattagtatatgtgaacttatgaaaaaatgttcttgtaaattattctagaatcccaaattttaattatataagaacaaccttttgttcaattgctttgaactaatgatgaagttttttaaaatattaagtattttatttaatgtgatatagattcaggaaaagtctaacaaaaatgtacttcagtagttttatttttattttgtgaaattttattttaaagtttaggtaaggaaagtttttaaactgtcttaaatatttaataaaagcagttgttaaaaatatatgttctaatgttaactatatgacatatatgccattgcatgcattttgttttttaaataggtttttcaccactggccccactagtagatgattttaccccagattttgaaaacataccactttaatggcctttatttcaaatacttcgtactttagggatagtattttgaagatgtttatcttttgtacattcctagttcatttattaatgtactaagaaaaagaaaacaaaatgactgattcttttgttttgaattaaatgtttgtgctgtattaatgttaagtgagttaagataaagggaagctacaaaaatttgaatgcctactaaatgctaggcactttataggtgtcttctaatatatgtctattggtatcacatcaattaataaccctgtgaaatgtcattagctctaattcaccaaagagtagatggaggcagagttgttatcagtttacataattaattagtggtattcacttggattcaaaactctgcaaactgaagccttatatagctcaaactagtcattaatctgccctcagcatgtatgaaaacataatgtttatccgtacagaccattctctatagcagatttgaataggtacttagcacactttatcattgtcactggctctttcgaaagaagtattaatttgtgcattctggtttaccattcatttcttaacaaagttgctttatacgttccataaaaagttttcatgaaaacattttacattagcatgttgtgtagtgggttttaagttataacaggtaattaacagatatttcggccaacgagacacacacacacatgaaaaaaataagtgaaaagacagaataaattgcaaaggttttacgagtggaccacaaagttaaggttaaacttctgtctttgcatgtggaggagacatattagtctagccagaactttccttttgcttagcagtgaggtcagagaagtatctctgtcattctgcttagaagtatacatggactgcaattgcttaatttacttaaacttaacattttcaatgggtttgctgtgtgaagatacagtctaagataagtgctttgacttgcctctgcagaggtcaacttatttctcatcacacacatttttcttatgtcatataagtaaaggaaagagtgaaacgttttatagaaaatattacagtggagttaagaacatctgcctcaaatgtacagtgcatttactttttaagttaatcatttagtagctacccttttaacctctactatgttcacagtattgcatttgctcttgtaaacaattttgttcccacctttacatagcgtatgacctactcagtgagaacattcattattaagtttttgctattaattttcatttaaaataggtttattaactagcaaatctcaaatgcaaaacatttttgagtgaatttttcctcaaatgttgtattctacctttcaaaatattgtgtaacagcaattccacattatccttttgaatgctacctatatattgccacatataaagatatttttcatttttcatttttcattgctatcttttaatccctttgcattttgataatatcgaaaacagattagggctgaaaaactaaaaaagattagggcttgtattatgcattgtctagttacttgaacaataagagaaattctatctttgagctttcataattggctttctggacaccactgagtttattagataatctttaaaaatattatgaactattttgagtggacctaaatttattcagtaataaagtttactttcctaaatccattccccaagtgaacaggcttatttaaaatatgtcatataaaagcacttttcctttctaacattttatgatttaggaattaaaaagtagctgttctttcagtaaataagtgttaataaagcagtgaccaaataaataaccttttgttagtttagcagataaatgttttcaatgtatgcctttaaaattattcagtaaaaattgaattagtacgtattcaacatgaaatttttagtcttttctgaccaagcactaataaaattgatttccctaaatgagaaaatttgtcttctgtattttaagcagaaaaaatatgaattctgcctctgataatcaaattttgtacagcaatgtgtaatgtgtcacaatttaaaaagttttaattttctgacatgcagataaggccaaaataaataataccatctgtttttttcacttgaaaatacatttttaaaattttgagtatatatattatagaggtccatgcaaatggaaaaaaattattctcttctgacatggactttttcatgactatacacatgctgaggctagaataaaaacatatatttgtgctatattgtaaaaataaaaacaatttgttctcctttctaattatatgcctttagaataaatgaaatgatctgc

SEQ ID NO: 22181 - DNA, 582 bp, Homo sapiens
  ENST00000547300
tatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtaggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaac

SEQ ID NO: 22182 - DNA, 574 bp, Homo sapiens
  ENST00000552503
aattaaccttttcctgacatgactacttctagtgcttattgcacgcccatgtactcaatccgacaagaaccctatgagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtaataaacgtggacccaaatgcaatgagaagaaacctagtatatatcactagagatgttaggaattaaaacaaaagggggactgttctaggcactggggacacagcagtaaataaaatgggcaaagcttcatgaagcttacattgtttctattccagtgggttgctctttgtggccaggatgtagcagaaaaataaaaaaaagaagatggagttttttgatact

SEQ ID NO: 22183 - DNA, 812 bp, Homo sapiens
  ENST00000549138
aagttaggcctggtggctaaggcctgtaatcgcaaccctttggcaggccatggagggagactagctcgagcccaggagctcaaggccagcatgggccacataatggaatcctgttgctacaaaaaattaaaaaaaaacagctggatgtggtggtgtgtgcacctgcagtcctagctactgaggaggctgaggaaggaggatcacttgagcctgggaggattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaagg

SEQ ID NO: 22184 - DNA, 762 bp, Homo sapiens
  ENST00000549401
ggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagcttatacatttgagatatattagaagcctgggaattcagcataatagccactgaaaatataatggctaaagaagaagaaaattatgagaacatttcaaaaacttacagattttttttttcatttctgagcctggtttcagaaatggaaacagcattgttaaaataaccttaacaacatttgcaaactgtggaagtaatttgctccttttgggacatttttcggcatggcttttgttagaagtttttttgtgtcttctggatggctctcttgtacctcgtttaaggtttctcttg

SEQ ID NO: 22185 - DNA, 589 bp, Homo sapiens
  ENST00000549922
caattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgagtactgttttattttcttatcctcttctttacccctagagctgtataataatgtactactagtgccattgtgactttagctgcatgagacaatcttcctttcattcttcatcttacatttcacttt

SEQ ID NO: 22186 - DNA, 4935 bp, Homo sapiens
  ENST00000539664
cagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacaacctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgccctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataa

SEQ ID NO: 22187 - DNA, 2214 bp, Homo sapiens
  ENST00000421984
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 22188 - DNA, 491 bp, Homo sapiens
  ENST00000423220
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagagcctgccagacagccccctgcgcttcgacggcct

SEQ ID NO: 22189 - DNA, 535 bp, Homo sapiens
  ENST00000476225
gagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcaagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 22190 - DNA, 426 bp, Homo sapiens
  ENST00000478964
ggtttaactgaaatgcctactattttagtaactacacatttccagcaaaagtaaagaaatgatactcaatttgattattcaccacagacgccaagatcattctttagtctgattttagcctcacgtggtctcacccgaacatttgtttttggaatttggacctaactggttaccaaacctgtctgcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggtaaacagcttgggatttggggagtcattcttccattcatccattcaatccatggcagcaaacagagcaataaaatgcatgaattctgg

SEQ ID NO: 22191 - DNA, 2217 bp, Homo sapiens
  ENST00000548732
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 22192 - DNA, 2214 bp, Homo sapiens
  ENST00000431059
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 22193 - DNA, 491 bp, Homo sapiens; identical to SEQ ID NO: 22188
  ENST00000426765

SEQ ID NO: 22194 - DNA, 535 bp, Homo sapiens; identical to SEQ ID NO: 22189
  ENST00000490570

SEQ ID NO: 22195 - DNA, 426 bp, Homo sapiens; identical to SEQ ID NO: 22190
  ENST00000474092

SEQ ID NO: 22196 - DNA, 2217 bp, Homo sapiens
  ENST00000548653
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 22197 - DNA, 426 bp, Homo sapiens
  ENST00000550400
atgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtacctcagagtgcagaaccacagacggcttcggctgtgcctagggcaacagccaacctaggagccagcgggctttcggggaaaaaaaagaaaaagacatctaaaataaaatgtttaaactg

SEQ ID NO: 22198 - DNA, 2214 bp, Homo sapiens
  ENST00000429524
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 22199 - DNA, 491 bp, Homo sapiens
  ENST00000424597
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagaacctgccagacagccccctgcgcttcgacggcct

SEQ ID NO: 22200 - DNA, 535 bp, Homo sapiens; identical to SEQ ID NO: 22189
  ENST00000493180

SEQ ID NO: 22201 - DNA, 426 bp, Homo sapiens
  ENST00000496657
ggtttaactgaaatgcctactattttagtaactacacatttccagcaaaagtaaagaaatgatactcaatttcattattcaccacagacgccaagatcattctttagtctgattttagcctcacgtggtctcacccgaacatttgtttttggaatttggacctaactggttaccaaacctgtctgcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggtaaacagcttgggatttggggagtcattcttccattcatccattcaatccatggcagcaaacagagcaataaaatgcatgaattctgg

SEQ ID NO: 22202 - DNA, 426 bp, Homo sapiens
  ENST00000552676
atgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtacctcagagtgcagaaccacagacggcttcggctgtgcctagggcaacagccaacctaggagccagcgggctttcggggaaaaaaaagaaaaagacatctaaaataaaatgtttaaactg

SEQ ID NO: 22203 - DNA, 2217 bp, Homo sapiens
  ENST00000550702
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 22204 - DNA, 2214 bp, Homo sapiens; identical to SEQ ID NO: 22187
  ENST00000259930

SEQ ID NO: 22205 - DNA, 491 bp, Homo sapiens; identical to SEQ ID NO: 22188
  ENST00000427952

SEQ ID NO: 22206 - DNA, 535 bp, Homo sapiens; identical to SEQ ID NO: 22189
  ENST00000492678

SEQ ID NO: 22207 - DNA, 426 bp, Homo sapiens; identical to SEQ ID NO: 22201
  ENST00000479020

SEQ ID NO: 22208 - DNA, 2217 bp, Homo sapiens; identical to SEQ ID NO: 22191
  ENST00000550969

SEQ ID NO: 22209 - DNA, 2214 bp, Homo sapiens
  ENST00000376694
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 22210 - DNA, 491 bp, Homo sapiens; identical to SEQ ID NO: 22188
  ENST00000433744

SEQ ID NO: 22211 - DNA, 426 bp, Homo sapiens; identical to SEQ ID NO: 22201
  ENST00000477944

SEQ ID NO: 22212 - DNA, 426 bp, Homo sapiens; identical to SEQ ID NO: 22202
  ENST00000376688

SEQ ID NO: 22213 - DNA, 2217 bp, Homo sapiens
  ENST00000619857
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 22214 - DNA, 2214 bp, Homo sapiens; identical to SEQ ID NO: 22192
  ENST00000427091

SEQ ID NO: 22215 - DNA, 491 bp, Homo sapiens; identical to SEQ ID NO: 22188
  ENST00000444157

SEQ ID NO: 22216 - DNA, 535 bp, Homo sapiens; identical to SEQ ID NO: 22189
  ENST00000498654

SEQ ID NO: 22217 - DNA, 426 bp, Homo sapiens; identical to SEQ ID NO: 22190
  ENST00000465041

SEQ ID NO: 22218 - DNA, 2217 bp, Homo sapiens; identical to SEQ ID NO: 22196
  ENST00000550694

SEQ ID NO: 22219 - DNA, 2214 bp, Homo sapiens; identical to SEQ ID NO: 22198
  ENST00000430090

SEQ ID NO: 22220 - DNA, 491 bp, Homo sapiens; identical to SEQ ID NO: 22199
  ENST00000440260

SEQ ID NO: 22221 - DNA, 535 bp, Homo sapiens; identical to SEQ ID NO: 22189
  ENST00000469125

SEQ ID NO: 22222 - DNA, 426 bp, Homo sapiens; identical to SEQ ID NO: 22201
  ENST00000473556

SEQ ID NO: 22223 - DNA, 2217 bp, Homo sapiens; identical to SEQ ID NO: 22203
  ENST00000546888

SEQ ID NO: 22224 - DNA, 426 bp, Homo sapiens; identical to SEQ ID NO: 22202
  ENST00000552836

SEQ ID NO: 22225 - DNA, 2214 bp, Homo sapiens; identical to SEQ ID NO: 22192
  ENST00000414873

SEQ ID NO: 22226 - DNA, 491 bp, Homo sapiens; identical to SEQ ID NO: 22188
  ENST00000425255

SEQ ID NO: 22227 - DNA, 535 bp, Homo sapiens; identical to SEQ ID NO: 22189
  ENST00000485505

SEQ ID NO: 22228 - DNA, 426 bp, Homo sapiens; identical to SEQ ID NO: 22190
  ENST00000479130

SEQ ID NO: 22229 - DNA, 2217 bp, Homo sapiens; identical to SEQ ID NO: 22196
  ENST00000552062

SEQ ID NO: 22230 - DNA, 513 bp, Homo sapiens
  ENST00000491446
cctggggcgtggtcgccgggctgccgtgcgctcgggatcagtctttttatacatatatatatgtgtgtatatatatatatatatatatacacacatatatatatgttataaaattctaacttcggtggagtactttactttgatattccacttgcaaaacagaaccactgattccttcctgcttgacaagattgagtcgctatcaaggagctgcccgtgctttggaaatggtccaaatcgacgaggaactgccaaggagccccctcagacacctctctaagccacacaagccacggagtatagtatgtctccatcaccaaagaggagcaatcgacacctctctgcatagacaagactatcttgaccagaggcactgacagccttccagggtggcagagagacctgtgtgtgcaaggtggcagagatgtggcgcagaagagatgggcacttactccagtgctgatacacagaagccagctttgttcaaaacagtgttgtttagcaaggttgcac

SEQ ID NO: 22231 - DNA, 583 bp, Homo sapiens
  ENST00000441616
ttgcaaaacagaaccactgattccttcctgcttgacaagattgagtcgctatcaaggagctgcccgtgctttggaaatggtccaaatcgacgaggaactgccaaggagccccctcagacacagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtc

SEQ ID NO: 22232 - DNA, 3832 bp, Homo sapiens
  ENST00000437508
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaa

SEQ ID NO: 22233 - DNA, 542 bp, Homo sapiens
  ENST00000496978
agcttgatgactataatgggcccagttgtctgcgggctgcggggagctaagtccccagattggaggaggctggctctggtcttcgatgcacaggagtggccgttatggaacgcaggagctgtgcttgcttataatgaactgtcatgatggaggccggcccgtttcagctctctcagccccgtcaagctgaactcacttcccctgaaaggacagtgtttgcatttgtgtttacgggactggggaagaggatgcgttttcaggagacctgaaaaccgagccaacccccttttcctgccccgctgtgctgcgattggcccatcttggaggctggctgcaggagcctttagtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaat

SEQ ID NO: 22234 - DNA, 909 bp, Homo sapiens
  ENST00000479711
agcttgatgactataatgggcccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaa

SEQ ID NO: 22235 - DNA, 2202 bp, Homo sapiens
  ENST00000494872
agcttgatgactataatgggcccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtggatggagtcttgcaggctgaagtacagtggcatgatctcagcccactgcaaccactgcctcctgggttcaaacaattctcctgcctcggcctcctgagtagctgggattacaggcatgcgccaccatgctcagctaattttttgtatttttagtagtagggatggggtttcattatgttggccaggctggtcttaaattcctgacctcaagtgatccacccaccttggcctcccaaagtgctgggattacaggtgtaagccattgtgcccggccagcattaatttcatattaagttggagtgggtggtgagaggaaatctgcatttattgatcccctatttcagtctaagggttcaccttatgtaatcttcctggaggggtaggtggaagtgaccaggaagaatatgggtgagaagctgttgaattaaaaattcattttgtgcttcataggctagacttgcatctggaaaaacaaaatgatttaattatggaattatagaataattgttaaattgattataattactttaaaaattcttgttattcattctactagctaatatgtaaccatcaaatgaaatcttttacattaaagtagatagaaaaat

SEQ ID NO: 22236 - DNA, 6735 bp, Homo sapiens
  ENST00000338700
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccattt

SEQ ID NO: 22237 - DNA, 656 bp, Homo sapiens
  ENST00000632856
ctggctgggcgcgcagcgaggcccaggcccgaggggtgaggcccaggccactccggagcgcgcgctgttcccgcgaagcgagtcgccgtctcgtacagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagc

SEQ ID NO: 22238 - DNA, 570 bp, Homo sapiens
  ENST00000502281
cttttcaacagacgctcagtgagaaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtagggaattttaaccagtctctttgcatggtgcttcccaacttgaagtgttagcagaaacgtgcgttgttcttttggattgccgcgtagctgcagcgacagacttgggaggatttaattctttgcctcgttggttagtctgtttgtcttcagaaatggcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagag

SEQ ID NO: 22239 - DNA, 773 bp, Homo sapiens
  ENST00000482578
aaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagccctcaga

SEQ ID NO: 22240 - DNA, 654 bp, Homo sapiens
  ENST00000433687
gtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaa

SEQ ID NO: 22241 - DNA, 580 bp, Homo sapiens
  ENST00000460908
aaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtactacaagcacatgagttgttgttaacttttaactgcttttatggagaaattggtctgcgagaaaataatgcaatacttacatatggcaccaaagggagttaaccagcagagtagactttgttctgctcaaagatgccggttttaacttggacttacagaccttggaaagtcaggaaattgaataaaatgtggtggcaataagttgcttaatttgaaactggtgcaaatgaagaggacttgaaaattaaattttaaaaagcaattcgttgaacttagaggcagaactttctgaagcttaatgttttgtggctagtcaataaattaaaatcactttttcaa

SEQ ID NO: 22242 - DNA, 3115 bp, Homo sapiens
  ENST00000493978
catgcatatccagccctgcgcagtctggcctctgccgttctcactaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22243 - DNA, 3250 bp, Homo sapiens
  ENST00000438908
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22244 - DNA, 3478 bp, Homo sapiens
  ENST00000455000
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22245 - DNA, 3318 bp, Homo sapiens
  ENST00000436219
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22246 - DNA, 1124 bp, Homo sapiens
  ENST00000446196
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 22247 - DNA, 682 bp, Homo sapiens
  ENST00000451189
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 22248 - DNA, 603 bp, Homo sapiens
  ENST00000422881
gtgcaggagcgggacccggaacagaccgccgtgagagaggaggggcgccggccgggattcgcggcccggagctcgggaccggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 22249 - DNA, 582 bp, Homo sapiens
  ENST00000435387
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 22250 - DNA, 502 bp, Homo sapiens
  ENST00000475230
acagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtg

SEQ ID NO: 22251 - DNA, 3115 bp, Homo sapiens
  ENST00000469107
catgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22252 - DNA, 3250 bp, Homo sapiens
  ENST00000450392
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22253 - DNA, 3478 bp, Homo sapiens
  ENST00000415923
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctacgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22254 - DNA, 3318 bp, Homo sapiens
  ENST00000428486
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22255 - DNA, 1124 bp, Homo sapiens
  ENST00000446540
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 22256 - DNA, 682 bp, Homo sapiens
  ENST00000450103
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 22257 - DNA, 603 bp, Homo sapiens
  ENST00000433361
gtgcaggagcgggacccggaacagaccgccgtgagagaggaggggcgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 22258 - DNA, 582 bp, Homo sapiens
  ENST00000431641
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 22259 - DNA, 502 bp, Homo sapiens; identical to SEQ ID NO: 22250
  ENST00000477569

SEQ ID NO: 22260 - DNA, 3227 bp, Homo sapiens
  ENST00000425831
ggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22261 - DNA, 3448 bp, Homo sapiens
  ENST00000432326
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22262 - DNA, 3250 bp, Homo sapiens
  ENST00000438384
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22263 - DNA, 3115 bp, Homo sapiens
  ENST00000464955
catgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22264 - DNA, 1041 bp, Homo sapiens
  ENST00000449136
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 22265 - DNA, 554 bp, Homo sapiens
  ENST00000419401
ggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 22266 - DNA, 473 bp, Homo sapiens
  ENST00000481596
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtg

SEQ ID NO: 22267 - DNA, 552 bp, Homo sapiens
  ENST00000445457
ggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 22268 - DNA, 682 bp, Homo sapiens
  ENST00000424124
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 22269 - DNA, 3114 bp, Homo sapiens
  ENST00000480999
catgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcccttctgaggagcaggacacatcattgagaactggagacttgctctcctccttatggttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22270 - DNA, 3250 bp, Homo sapiens
  ENST00000437089
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22271 - DNA, 3478 bp, Homo sapiens
  ENST00000454678
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22272 - DNA, 3318 bp, Homo sapiens
  ENST00000453195
gggagattacggggcggggacgagctgtcgcgctggttgctcgtgcaggagcgggacccggaacagaccgccgtgagagaggaggggtgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22273 - DNA, 1124 bp, Homo sapiens
  ENST00000416596
acggggcggggacgagctgtcgcgctggttgctcgtgcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 22274 - DNA, 603 bp, Homo sapiens
  ENST00000418026
gtgcaggagcgggacccggaacagaccgccgtgagagaggaggggtgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 22275 - DNA, 582 bp, Homo sapiens
  ENST00000434785
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 22276 - DNA, 502 bp, Homo sapiens
  ENST00000487829
acagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtg

SEQ ID NO: 22277 - DNA, 3114 bp, Homo sapiens; identical to SEQ ID NO: 22269
  ENST00000463977

SEQ ID NO: 22278 - DNA, 3247 bp, Homo sapiens
  ENST00000383607
tcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22279 - DNA, 3478 bp, Homo sapiens
  ENST00000327357
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtcttcaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22280 - DNA, 3318 bp, Homo sapiens; identical to SEQ ID NO: 22272
  ENST00000396558

SEQ ID NO: 22281 - DNA, 1124 bp, Homo sapiens; identical to SEQ ID NO: 22273
  ENST00000412755

SEQ ID NO: 22282 - DNA, 603 bp, Homo sapiens; identical to SEQ ID NO: 22274
  ENST00000419171

SEQ ID NO: 22283 - DNA, 582 bp, Homo sapiens; identical to SEQ ID NO: 22275
  ENST00000427612

SEQ ID NO: 22284 - DNA, 502 bp, Homo sapiens; identical to SEQ ID NO: 22276
  ENST00000461313

SEQ ID NO: 22285 - DNA, 3115 bp, Homo sapiens; identical to SEQ ID NO: 22263
  ENST00000472707

SEQ ID NO: 22286 - DNA, 3250 bp, Homo sapiens; identical to SEQ ID NO: 22262
  ENST00000422349

SEQ ID NO: 22287 - DNA, 3478 bp, Homo sapiens
  ENST00000445259
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22288 - DNA, 3318 bp, Homo sapiens
  ENST00000427535
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 22289 - DNA, 1124 bp, Homo sapiens
  ENST00000423901
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 22290 - DNA, 682 bp, Homo sapiens; identical to SEQ ID NO: 22268
  ENST00000444979

SEQ ID NO: 22291 - DNA, 603 bp, Homo sapiens; identical to SEQ ID NO: 22257
  ENST00000415789

SEQ ID NO: 22292 - DNA, 582 bp, Homo sapiens
  ENST00000447942
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 22293 - DNA, 502 bp, Homo sapiens
  ENST00000477353
acagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtg

SEQ ID NO: 22294 - DNA, 3114 bp, Homo sapiens; identical to SEQ ID NO: 22269
  ENST00000487616

SEQ ID NO: 22295 - DNA, 3250 bp, Homo sapiens; identical to SEQ ID NO: 22270
  ENST00000433314

SEQ ID NO: 22296 - DNA, 3478 bp, Homo sapiens; identical to SEQ ID NO: 22279
  ENST00000447711

SEQ ID NO: 22297 - DNA, 3318 bp, Homo sapiens; identical to SEQ ID NO: 22272
  ENST00000456093

SEQ ID NO: 22298 - DNA, 1124 bp, Homo sapiens; identical to SEQ ID NO: 22273
  ENST00000438785

SEQ ID NO: 22299 - DNA, 682 bp, Homo sapiens; identical to SEQ ID NO: 22268
  ENST00000415966

SEQ ID NO: 22300 - DNA, 603 bp, Homo sapiens; identical to SEQ ID NO: 22274
  ENST00000433836

SEQ ID NO: 22301 - DNA, 582 bp, Homo sapiens; identical to SEQ ID NO: 22275
  ENST00000429583

SEQ ID NO: 22302 - DNA, 502 bp, Homo sapiens; identical to SEQ ID NO: 22276
  ENST00000486529

SEQ ID NO: 22303 - DNA, 3318 bp, Homo sapiens; identical to SEQ ID NO: 22272
  ENST00000425523

SEQ ID NO: 22304 - DNA, 3478 bp, Homo sapiens; identical to SEQ ID NO: 22279
  ENST00000439094

SEQ ID NO: 22305 - DNA, 3250 bp, Homo sapiens; identical to SEQ ID NO: 22270
  ENST00000456770

SEQ ID NO: 22306 - DNA, 3114 bp, Homo sapiens; identical to SEQ ID NO: 22269
  ENST00000471458

SEQ ID NO: 22307 - DNA, 1124 bp, Homo sapiens; identical to SEQ ID NO: 22273
  ENST00000422802

SEQ ID NO: 22308 - DNA, 603 bp, Homo sapiens; identical to SEQ ID NO: 22274
  ENST00000453442

SEQ ID NO: 22309 - DNA, 502 bp, Homo sapiens; identical to SEQ ID NO: 22276
  ENST00000484938

SEQ ID NO: 22310 - DNA, 582 bp, Homo sapiens; identical to SEQ ID NO: 22275
  ENST00000440149

SEQ ID NO: 22311 - DNA, 682 bp, Homo sapiens; identical to SEQ ID NO: 22268
  ENST00000438064

SEQ ID NO: 22312 - DNA, 2991 bp, Homo sapiens
  ENST00000380034
gcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatcta

SEQ ID NO: 22313 - DNA, 2290 bp, Homo sapiens
  ENST00000380027
atttccttctagaagccaggagcaaaggacagacctctctctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctgaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagtgtgagcaagaatttcctgcggttcctctaggaaaattcctttgtgcagatcaggcccgtggattgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 22314 - DNA, 2759 bp, Homo sapiens
  ENST00000433961
gtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaa

SEQ ID NO: 22315 - DNA, 3170 bp, Homo sapiens
  ENST00000396847
ctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaa

SEQ ID NO: 22316 - DNA, 767 bp, Homo sapiens
  ENST00000438025
gtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagt

SEQ ID NO: 22317 - DNA, 918 bp, Homo sapiens
  ENST00000483835
ggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggctggagtgcaatggcacgatctcggttcactgcaacctccacctctcagattcaagcaattctcctgcctcagcctcccaagtagctgggattacaggtgcccaccaccacccct

SEQ ID NO: 22318 - DNA, 662 bp, Homo sapiens
  ENST00000492086
gaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatccctta

SEQ ID NO: 22319 - DNA, 602 bp, Homo sapiens
  ENST00000465634
gctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagaggtgaggagagctagatcaacaacagggttatggaattcaagtggtgttagggtgctaaatagggaagagggtgcagtttccaaatatggatagaggggata

SEQ ID NO: 22320 - DNA, 756 bp, Homo sapiens
  ENST00000487241
gtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtaaaaagtggaaagaagcctgagcactgagattaaagaaaagtgaaggctatttccttctctgcgttgctgtgctttttctaatattaacaatgttctctgcaggaccgcttttctgaatcaattgctgaagttataagaataattgaatgtagaagtagcaagagataatcccatttttattaatttatccagagcagtagaaaaatttgacgtagtggagatgatcaattagctctagtcatgtttgataggttc

SEQ ID NO: 22321 - DNA, 1054 bp, Homo sapiens
  ENST00000412903
tccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccgcaggtctaaggcccgcctgttctgtgccgtgacctgtgctaccgaagtcatctgttgctgtagggaggccagggactcagccgatgcctcaatggccaactgcagggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagaca

SEQ ID NO: 22322 - DNA, 607 bp, Homo sapiens
  ENST00000419850
cctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgaatgaagccgcggacgcttgcagtgagtgttacagttcttaaaggcggcatgtccggagtttcttccttctgatgttcggatgtgttcagagtttcttctttctggtgggttcgtggtctcgctggctcaggagggaagctgcagaccttcgcgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcat

SEQ ID NO: 22323 - DNA, 4050 bp, Homo sapiens
  ENST00000282369
tggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaagaa

SEQ ID NO: 22324 - DNA, 4218 bp, Homo sapiens
  ENST00000513154
gtccacgccccgcggtgccccgcccaggtctctgcgcggcgccgttcccagccgcagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaaga

SEQ ID NO: 22325 - DNA, 1952 bp, Homo sapiens
  ENST00000514154
atgtcggagtctggggagatgagtgaatttggctacatcatggaattgatagctaaaggcaaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtag

SEQ ID NO: 22326 - DNA, 631 bp, Homo sapiens
  ENST00000513485
agtttaaatccattgtttctggccgggtatggtggcccggcactttgggaggccaaggtgggaggatcacctgaggtcaggagttcgagaccagcctggacaacatggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtg

SEQ ID NO: 22327 - DNA, 805 bp, Homo sapiens
  ENST00000515104
ctccacggccgccgcagggacccgcccaccagaccctgcgctcggtagccggtgtgagtggaacgtgccgctgatgacacctggcagaaggcagccatggagggcgatggctcagattcgccggtgtcgaatgtgcaattcttccgaagtttctcgaggaactgcttaattgagggagccgccacatcacacttaatcagtttgtttctccctcaatgacagatgaactaaattttctcttgggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagg

SEQ ID NO: 22328 - DNA, 585 bp, Homo sapiens
  ENST00000510222
attcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaag

SEQ ID NO: 22329 - DNA, 786 bp, Homo sapiens
  ENST00000508894
cgcagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccagcatcacaacggagatctgtggggtggagaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatgg

SEQ ID NO: 22330 - DNA, 693 bp, Homo sapiens
  ENST00000379618
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaa

SEQ ID NO: 22331 - DNA, 310 bp, Homo sapiens
  ENST00000511701
tgtttctatttcttgtttagtatataccaatagaatggtggtaccctgcctgtctgatctcagagcaaaccaattaatatgcaccatggtcattaggacttgacccagccatgaatttaatctcttgttgggtattaggaatcaatatggaaaaagaccaagtcagcttatggagtagtatatgatttataggatgccggattggagacgaggctaccgctgcagacagggctgtgggaagacgacggaacttgccacagcgacagacttctcccaaacaggaaataaaagtgggaagcattttaaaacc

SEQ ID NO: 22332 - DNA, 1322 bp, Homo sapiens
  ENST00000379617
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtc

SEQ ID NO: 22333 - DNA, 4615 bp, Homo sapiens
  ENST00000543469
aactgtgttggtgtttgtggcttttctgaaaacacgatgaagcatcgtgaagataaatatcaaagacagtgaactaacaaccatttttatgacatgagacaataaattgaaaacattaaagataacattattttaattttagaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctgatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatattttatttgcactgtcttaatgagacttccatactcaggagtggtagctatgggattttcacatgggttctgggtacttctaattctttgaaacttagtactgcaggctgggtgcagtggctcatgcctatagtccagcactttgggaggctgaggcaggcagatcacttgaggccaggagtttgagaccagcttggccaacatggcaaaaccctgtctaccaaaaacacaaaaattagctgggcactgtggtgtgcacctgtagtcccagctactcatgtggctgaggcacttgaatcgcttgaacccgtgaggcagggttgcagtgagccaagatcttgccacagcactccaccctgggtgatgcagtgagactttcaaaaaaaaaaaaaaaatctgagctctactgcattggttattaaaatataataaaagtattaaattctattttcgcaccaaatgaaaacacttgattatcattatagcactttaaacttacttttcccttatatattcttgatttagaacaaattaccgtacttgaatttccgatcttgctttctttaaatctttatttaaaagtccatgctaataatgtgtttacatttttacagttacattatgatagaaactgttggattttttaaatatctaaaacaatggcccactgaagaaaggaacaattaactctttaattaattccttaggataaatacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaagtaattaacccctaaatagatgctcctcaacagtgggactacatcctggtaaacctatcataagttgaaactatcaagttgaaatgcatttagtacccggataaacctatcataaagttgaaaatttgtaaattgaaccagtgtaaatcagaggccatcttacttcatactcatgaagcaactatagtgggatatttttcaacttacgagatagcctaggcttgttgaaacactgtcctaatttactggctctctggtaattaagtcataaatggtcaaacatcaaattctagaaaagcatatatttaaattctcatcactataattcagaatgactggtttacaaaaatatgttcatagtatttgggtaataactgtggtgattgtctcaactggcaagctaagtggaatgccttaaagaatctatccaagattagttggcaggcatttccagtgttggtaaatcaaaggcccacgaaggtatgctgagccttgatagcacaaccttgcttaggactttgcctcaactaacatactttttagtttggcaagttacctgaccctccaggtaactcatttttctccatagtctgctacttacaagattgtcatatttttgtaatctagaagcaattatagagaatattttattagactttacaaatgacaactgcataaaacagaaaccagtttcatgatctagtttagggagtatgtattttatacaactcataatcctttacaaatagaaaaaaatcagtaatacactgaatcaacttgaagaatcttcagcataaagttcaacaaagtcccttagatgcaatttcttttggatttacagcaacactttttgttatgttgtatgtcttgtaaattccaataagtctatccgaaatctcaaacatattatttcgaagagaaattattatgaactgtgcattttttgtttgttcctaaagagaaacaaagaaaagtcaaacattaagtaataacaggtaaatcacacaaacatgtaacctcaaatattttttggacaataaacattacattgataacatgtaaaggaatgatggcaggaataattcataaaacagtatttgagtgtgaaaggaatttggttattttgacttctagtggaaaagatctaggaagatgacctaggattctagctgtgattctgctactaatttgcatttttaatttatattttactcctccaaaatggaaatatttggttcaaataaaaaataatttggtctccactgataccagaggagatggagatggagttattagacaataaagaaaaagctcaattgtaagaaataaagaattccatgtgtaatgtttaggatacccctaaaagtttctggaatgaaaatcccaaaatgattacttacatatatataaaatgcaacaatggacacatttttaaaatcaagggctgcatcaatctcatccatgaagtaaaggggagtgggcttgtagtggtgaagagcaaatactaaagccaatgaactaagtgttttctctcctcccgaaaggttgaagatctttttccaacttttcttaggtggtcgaacactgaaatgattaagaaaatcatagtcaaattacctgtaaagctaaagttaagactttgtgatttgctttccataattgagttctactatcttttttaggaatctgtaacttgcttttcacaaatatgaattctcttttctgttattttataaaaacgttattggaggatgcatacataggagcacataccaaagttttaagatttaaagagcaagctaagtattatacttcttgctattctttctccttatcaaatacaatttctcaatcctcatgttaaaaatgccttgaaaatttaagaaaagatgaactagacaaatattttgtaaatactggctgtctgcccctgtaaactgcaagcataaatagcatgcaagcaaattagtatttactagtaaatgaaacaagttgtacatcttgccttcacatcctacctccaagaaatactgagtttggagaatatgtagaaaaaggtaacagtgggattataaactcagcataattacacacctgaacatgattccttcagagaaaggatccaagctgtctacaagctcgagttcggcgtcccctcccaaagt

SEQ ID NO: 22334 - DNA, 601 bp, Homo sapiens
  ENST00000468542
aagcgattctcctgcctcagcctcgtgagtagctggggttacaggcgcccgctaccacacccggctaatttttgtatttttagtagagacgaggtttcaccatgttggtcaggctggtctgaaactcctgaagagatccgcccacctcggcctctcaaagtgctgggattacaggcgtgagctaccgcgcccggcccgagacccctttcttgtctctgcatagcgcccacccctggcctagagcctcttcagctttccatcactaagctaagctctcacctctactttagcctcttccttacttagacttgtgttatgggcttcctccactctgattaacccatccacatgctccgatcttctcatcttcctgaagtcatttgatacctctcatctaatggttcagccttcactggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagt

SEQ ID NO: 22335 - DNA, 577 bp, Homo sapiens
  ENST00000494486
gggggcgcgacgatggagggagtggcttgggacctgcactcattccctcttgtcccatactggagtttggggagccactttcccgtccctccactgtggagctgcgttcctgtgagggaggaggccctctgtggtggcgagggtgagctgagcggacgccgccgagtcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattaga

SEQ ID NO: 22336 - DNA, 576 bp, Homo sapiens
  ENST00000471155
gcgctgtgtttccgtgctgtggagttgcctggtccgcttcctccccgcgaataagaataaaagattctggaggagttggagaagagtgtattcagcccccaaaccacgagatcaacaaattaggtccacaaagatgtgagccccagtttgggtggtggcaccacttgaattttcccatacttaaagctgactcactagaagtcttgggacaagtcatcgaattctataatgaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaat

SEQ ID NO: 22337 - DNA, 603 bp, Homo sapiens
  ENST00000496222
gtgtttccgtgctgtggagttgcctggtccgcttcctccccgcggtgagtctaaggacctttacggatgcggagaagaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacag

SEQ ID NO: 22338 - DNA, 548 bp, Homo sapiens
  ENST00000471396
gctgtgtttccgtgctgtggagttgcctggtccgcttcctccccgcggtgagtctaaggacctttacggatgcggagaaggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacaca

SEQ ID NO: 22339 - DNA, 860 bp, Homo sapiens
  ENST00000479460
ctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgaggaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgat

SEQ ID NO: 22340 - DNA, 3867 bp, Homo sapiens
  ENST00000309784
agcccttcggggcagaggagggcggggactcggggcggctctcagcatccgcctggagctcgtggcgctgtgtttccgtgctgtggagttgcctggtccgcttcctccccgcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggtaaggatgaaaaggaagttgaatttttaaaaattttaaacattgttgtagttacattaatttcagtaatactgatgtcgatactctttttcaaccaacacatcataacctttttaagtgaaatcactttaatatggttttctgaagcctctctatctgtttaccaaagtttatctaacagtctgcataaggtaaagaatatactgtgtcacattttctatttgttgaaggaatttgtgtggaaaatagtttcccattgaaaatgtcaacctgaattgtttaaatgggcttattctgtacattgctaaacaaaaaatggggtagcatggataaagagcaaactaagctttattagtgctgcaactaatataaacaaatgtttatatttgttgcttcttttggttagcaatgatatgtcaaagttatatctgaaatagtcaaatctttgggaaacagaatctagtaacaatttgaaaagtaatacactatcccatttttattggctttatgatggttgacataatgttgctgtgacatttaaacattcttgtaccaatattgtcttttaccattattatatactgcagttaattggctttacagttctttatatatatagcaaaatcctgaaagaacatatacctttattttgatgtggcttgaagcttttgaatgggtgaataaggatgatagaaaggtttcaaaatcaagcaacaaagtcttaaagtgataaggcatggcttaaagatcttttgatcaaacatacctgtgtttgagatagatttaagagccctaaatgcttatcaccattcactccaaataaaactattgcttttggataactgttagagtaaagtggctttttaaaagaaatttttgagactgggtctcaccttgttgcccaggctggagtgtagttgtctggtcatgactcactgcagtttcgaccacccaggctcaatcgatcctcccgcctctgcctctggagcagctgggacaaggcacacacccccatgcctggctaattaaaaaaattgttttttgtagaaacgaggttttgccatattgcccaggttggtctcaaacttctgggctcaagagatctgcccaccttggcctcccaaagtgctgggattacagacgttagccacactgtgcctgggggccagcattttctaatacttgtcatattctatagtttgtgcaaatttaagattgtttttttttctgctcgtcagtcaaatcagttcttggattaaaaactcattcttattagaacagaatcatgttggtaacttggtctgcaacaggttttgatggcatcatgtggactttattcatcttaactcatttaaattttctaccacattcccttaagctaatgcaaaagtaccaacaacttaatcttttttttttttttttttttttttttttgagacggagtcttgctctgtcgcccaggctggagtgcagtggcgtgatctcggctcattgcaagccccgcctcccgggttcacaccattctcctgcctcagcctcccgagtagctgggactacaggcatctgctaccacgcccagctaattttctgtatttttagtagagatggggtttcactgtgttagccaggatggtctctatctcctgacctcatgatccactcgcctcagcctcccaaaatgctgggattataggcgtgagccgccacgcccggcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatatttta

SEQ ID NO: 22341 - DNA, 3437 bp, Homo sapiens
  ENST00000291416
ccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctggaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtca

SEQ ID NO: 22342 - DNA, 1638 bp, Homo sapiens
  ENST00000543586
tctcaggttcctaacccccagagaggggatccgattcagtctcagccgccccctccaggcctcatgtgaccattggagcccttcccaaggcttccttcatgccagagaagacagcagtggatcagccttggacgcaagccctgagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagt

SEQ ID NO: 22343 - DNA, 806 bp, Homo sapiens
  ENST00000485148
ggctggttccgggttgagaggctgcgctggaccgaagcggtggctgctaagctcgcggggcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccg

SEQ ID NO: 22344 - DNA, 306 bp, Homo sapiens
  ENST00000486583
ggattcggctggttccgggttgagaggctgcgctggaccgaagcggtggctgctaagctcgcggggcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagc

SEQ ID NO: 22345 - DNA, 9320 bp, Homo sapiens
  ENST00000444294
gggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctccgccagtctcccgagctccggccattcatccccagcgcagagcagcgctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaattgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattagccccgctccagctcggcactgtgcctgtgacagtgacattcacaggcaaaacgcccaccattctcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcgggcttcatgtctatgtttcctgccatctgttttcaaagcttgtctttttttggagggagaggaaggtagactttgagactggcctcctgagagcggcagtcaggagctgcgctgtaatcccacgccccgggtgttggccctccgtggggaccttgcctcctcagagtcccgagattgcagattctcatcatgctgagaaagttatcttttagcttcttggtcctagagtctttagtagcacctgccacttgcagacccaatgcaggattgatagaaagggacattaatcattcatgcttgacttttgcctctctcactgaagtgttagaaccttttaaaatggcttcctttattaatcagccaattgtgttctctctctctcttcctccatccttcatttcttctccctccctccttctctttctctcttcttctctctctccttccttccctcctttgctctctctttcttcctttcctccttctctcttactttcctccatccctgcctctttcttccctctttcgctctctttccctccctccttctctctctctctcacacacacacaggcatgacagtctcctaaaattaattcactcagttcttagttcttaaatccacgtgaaaacacaagaattttaacaactatgtcataggtcttcgcctggtgatggctcctttctgaaactggcagcccaagaagttaactgaaaatgcatccagattgctcttctgagctgaaccactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagcaccaactgtgcgtccttggttctgccttcctgttcagacaccgcgcctgctttctgagtaactgcctgccggagccatgcaggtaccccccctccactcagcaggcccgacaatcctacctcaaagctcatgctcttggtctgcaaggctgcttggtccgctgtctctgcagatgtggccggcaaggccagctgccccgtctccaggagctgctcggtgctgtgttgcagtctctgctgcggagcctgggagctatctgcttcatggaagtctaggtcttgcctcttccttgtcatctcaccaagcggtttctgggtctcctcctcccatcccagagccctgtccagagctcttggtggtgacacacaagacctgggaccctgtgtccttgcccgcacctctgcctctgtctcccatatccctgcagcttcatccttagccatagctctgggtggcctttgcttggagcatggagacgatccctaaagattgaggatgaagaggagccaccactttcctggggccaaggaagccatcagctttgggaagtgtctagctctcttctgaaaaaaaaacaggcctacaccctgcccccagaatgagagtgggctaggcagggctgcctggtgacagcagcttctcacaggggagccctggggaaggctgtggagcctccaccatcaccacagcccaggtcaccaggtggccccagctctgcagaagaatcgcccatcattggagcacaagttgcctggggctaccctgaacctaacccctttgagggagcagcatccaggtcaggagagaagtggaaagtgcaggagggtaatgccctcaaatccggtggcctctttcagaaaaaagttccctgaagtccagagaggtgcagccaggactccctcctccccactgccaccctgagcttgggggctgggattctcccttttctgactcctccaggagcccagaagcaatacggccgatgccagggacagcatccagctctccttcacagacacctctcctgtcttcagcacaaaacaccttcaatgttctgacttcaaagagaacgacaggtccgtgccacacacttgtgtttttgagggatcagaaaagtgaagaaggaacttatcaattcctcatggccaggaaggtcccgggtttcagagtagaaatgacagacaggtcatggaattctcatccaccatcgaattccataacacgttacatcatggtggcacatttgtacatacatataaatgatatcaagatgaggcttttgttgggctggctgaggagtaacttggtgtaaatctatcaagcagtttcagtgaaaaaggaattcaaagtagtttaaaaatgtcgagttccattgcattgtaaatagtgcctctgtaatgtggttctgcagttgttctttgctagtgagcaagcttggtcaaagtgtatgccttttccttttaaaattaatctcttccgaaaatatccactagcacctcactgcatacatagcatcccagctcctaattcaaagcaggggaaggtatttccccaaagcctgcttttcctctctctgttctccttgggaaaataatgattccaattaaagaggacaccagtaatactgacccacaaggtaactgacctaaacactataaaactgtatatatttccaggctgcatcttcagcctgatatgtactttgtagttgcaacagcgccctaggtgccctatggcccaccaagtttgaggagggtggtgctttccggattgagcctgggcaggctctgtggagctcaccaagagagctgggggcaggcccaccctcctctttgcgccctttctctccctcttggtgcccctgccctccgccccaccacagcactctcaggaaaggatcagaatgcaggatctttgtgtatttcttccagggatatttgcatttaagccttaattctcattgcaagcgaaaggcttggtccccctgggaaggcgggtttcggcaccggtgggcaggtggttcagtgtcaaggaggctgctgctggtcccatggccacctgctggctttgaggtagtgagggagggtcaatccttagggggagtcaacatgtgaatgctaaagaacactgctgcacagcccgtggggtggcgccagggtttctcaacctctactgacattttgcgataggttctgtatgccgtaggatgtttagcaacatccctggtctctacccatcatctgccagtagcaacccccaagttaggtgtgacaaccaaaagtatctgtcgacattgctaggtatctcctgggggcctccacaagttgagaaccaccaggttatgccagtggtttgtcatgcatggatctgtagagggactgtggcgctccggctgctttgttccatagaaagcctgtatgtgacaaagctgccagcctttatcttgatacccaagcccaggattttccatgtgtcttcagggggcaggtaggggaaaatggggtgagccacctccaacagatgccaacctgttgggtcttgaattttcactcactgaagatgccccctgcccgctccccacttcctagaaagcaaaactcgttacctttgttttccttggccacattttactggaagcaacaggaacttcttaatgggtttgtggccctcaattggtttttaaaaaaatctaacagatcttattggcaaatattcaagatggtgatgctggaaaatttcaggacttttcttttgcaagtgagccggtagctgtgtttgttgaccacattctttggcagttcctcccagaagatcaaaggatcctgcagctttaacctaatatctaggctgtaaaaatatgagggcaggtttcgggcaggatgtattgatcagacaccaagttcagccctcggttacttccctcttttaacctggctttaatagtgattcatggtatgagtgggggccaatctcttatcctttctgtgcctcagtatccccacctgaaatgagactagtcatactaacctacctcctctgatgtattgtgaggattatacaataacatttttaaagaaaaaaagtgcagtctttcatctctggcatctaagctaatgattcccattcagtgactcaaacctgtggggggcgttccagtgttctctgaccagtgtcttccatccaagcctccttgtgaccagggcaaggagctgcctggcctccagtgggtaaaatagacctttaagacaggtttcctatgaccatagaaagtaacaccccatatgtttccattcccggcgaggcctgtttgaatggcgctctgtgtgagtgctatgaacaggctacctgtcagcagtctcactgcgaggcctcaaggcctctgtgagcagaagcccctttaaaccaaggaaggacactaacccaggcctctgccttctttgttacctaagttctggtatctaaggggtctctcatctcacagcttgcctcctttgtttcgaggggtctctgcagtgtgaatgggtttgaaatccagtgtggatagcacgaagagatgcaactgagccgaagttttgaaggctggttgggctagtgggtcatcatgtcactttcagatgactgataaccgctgggactgctggggcttcaccagcacgagctatgcaggttgggggaggccctggctttttcaatgattgacgttgacatcagtcaggagctgggagttgagacctccagggaagtctcgtccggatccatcgctcttctctcaaggagcacagtcctgggaaaggcctagggacctgtgggccggtgatgcgggcactgcagaccaggccaggccctcgggtaaagctctgaggagaggccaaaaccaggcttcaggttcgggaaggtgactgcttgcaactgcagtagcaggaacatgtcaggtgcttactgggtgagacccagccggggaagcctctccaactcctcctagccctggaaaccagacacccagagccccaggctttctcggcacccagaagaagtggggagcgggcaaagcagaaaacattcaatgcatgatgtaggattgctgcgttggcactaagctgttgtattaagcatgagaggtgtttgtttaacgttggcaaagggatttaacaagaaacaaaaagcttcgcgtccttgttttgaccgtcgacagaagtccaattttcttgcctttctttatccccatttctcctccctccccttcccccatcacatccactttcggtcactcgttgttggtatttggtggcagctcttggtcctattgctgtggatgttccactgaaaacacggggggtagcggggagtggtaaggaaagcaacttttttctaatttttgtattggtatccacaagcgtttgtattttttgaattgcaaacactgtgttttctggtctttgggggttagttgaactttctgtattaccttttggaaaacctgagttttaccacagtcttaagcagatttgaaataaattcttttgacactgccaa

SEQ ID NO: 22346 - DNA, 2166 bp, Homo sapiens
  ENST00000449018
atggaggaagagctgaagtgtcccgtgtgcggctctctgtttcgggagcctatcatcctgccctgttcccacaatgtctgcctgccttgcgctcgcaccatcgcggtgcagaccccggacggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctgggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattag

SEQ ID NO: 22347 - DNA, 3936 bp, Homo sapiens
  ENST00000366653
atggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattagccccgctccagctcggcactgtgcctgtgacagtgacattcacaggcaaaacgcccaccattctcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcgggcttcatgtctatgtttcctgccatctgttttcaaagcttgtctttttttggagggagaggaaggtagactttgagactggcctcctgagagcggcagtcaggagctgcgctgtaatcccacgccccgggtgttggccctccgtggggaccttgcctcctcagagtcccgagattgcagattctcatcatgctgagaaagttatcttttagcttcttggtcctagagtctttagtagcacctgccacttgcagacccaatgcaggattgatagaaagggacattaatcattcatgcttgacttttgcctctctcactgaagtgttagaaccttttaaaatggcttcctttattaatcagccaattgtgttctctctctctcttcctccatccttcatttcttctccctccctccttctctttctctcttcttctctctctccttccttccctcctttgctctctctttcttcctttcctccttctctcttactttcctccatccctgcctctttcttccctctttcgctctctttccctccctccttctctctctctctcacacacacacaggcatgacagtctcctaaaattaattcactcagttcttagttcttaaatccacgtgaaaacacaagaattttaacaactatgtcataggtcttcgcctggtgatggctcctttctgaaactggcagcccaagaagttaactgaaaatgcatccagattgctcttctgagctgaaccactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagca

SEQ ID NO: 22348 - DNA, 1954 bp, Homo sapiens
  ENST00000354556
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaaggtggaaactgagtcagacagaggcgaggtgacttgtctgaggtcacagctagtgagtggtgaagccaagattggaacccaggcaatccagcttggaaggacaaaggatggggtctctgaaacatctccagcctcagccctgctcctggccttctctctcatccagacatggctgcagcctctgggctgggactggcctccctacctccccttcaatccagtgcttccctgctgccagaaggagctttccagaaagcacatgtcaccacagccctctcttgctggaacccaacctctacaggagaccaagctgcctcctacagaccacaggacctccaagactcaccatcgccacctcttgttattcctgccctgactttcctatcaccaccatcaaaggagagtcccccagagattacatctcatggcccgggcttgcggagtgctgggctcccagacaaatgcaatcaaaggagacatgtctcctgggaagagcctcccacaacctcaaagccccgaaagccctccgtgtttatgttcttgcttgatccccacaaccgtccagcaaagccagcacagcagagatgattctatttccccaggagtggtgcccagagaagttaagcagtttgcctgagatgacacagccgtgttggagccgtgcttgcttgggatgaactaagtggcgcgcatttgattttactgctgatttcacagctccttcagctaccccaagctgccatcaatgtcccatcaatttcactttgtctgctcctctctgcaatgagctttctcagctctcagcctgtgttcagtaaagagacgttgctggtcttgtgtcacgtctcctcctgcctgaataatgctcgtgtgcagcatgaaggagaggtctctcagaactcaagggcctgaagctcccagaagcttccagatccagaggcaacaggtgtcttccggtcccagggagggcaagtttcctgaacctcgaaggcaggcagacagtggaggcctcccttccttctcacagcatcctccagctccaaggcaggcttcccccaacccccagggcccaggaactgtcatcagagcagaaatcaagcccagtcccaggcctcaccccacagggcatctgccccattgatatttgcttggtaataaatactggagacagaggg

SEQ ID NO: 22349 - DNA, 3381 bp, Homo sapiens
  ENST00000395648
agtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgaagtgggaatgatggctccatttcacagatgaggaaaccgagactcagagcacaaggccacacagcaggaagagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 22350 - DNA, 3703 bp, Homo sapiens
  ENST00000533940
agtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaa

SEQ ID NO: 22351 - DNA, 2647 bp, Homo sapiens
  ENST00000525680
aagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctccc

SEQ ID NO: 22352 - DNA, 2045 bp, Homo sapiens
  ENST00000532253
actgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccag

SEQ ID NO: 22353 - DNA, 566 bp, Homo sapiens
  ENST00000524774
agaaaacccaatcataggaccaggtaacccattaactcatgaactccatgaacacagcatcctcctgacagaaccggacatgggcaggggccaggggctcagtcctccccctttataaagagatcgagtctcaatgcggggaagtgactcgcccagtgtcacatagggccttggaatgacaggagcaggctgaagcagcagcattgagtctggaggggacaggatcggggacagacagctttgatttgagaaatgtgaataggggcggaggcgtggagtccaggaccccagctgtcttgcagcagtggccagaggaagcaggagcagtcctcctgccctgctgggagggagtcagctgtcccacccccagcccccttttcatcccccgccccaggcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcct

SEQ ID NO: 22354 - DNA, 658 bp, Homo sapiens
  ENST00000528473
gatgtgaggcgtccgagcccggagcctccgcctggcatcagctccacgtagcccagcgccggcacgcgcgaggcccatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtcc

SEQ ID NO: 22355 - DNA, 502 bp, Homo sapiens
  ENST00000528290
aagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcatctccctgatcatgtggaacgctctctacacggctgagaaggtcatcattcgatggaccctgctcaccgaagcttgctatttcggggtccag

SEQ ID NO: 22356 - DNA, 530 bp, Homo sapiens
  ENST00000533955
ccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagcatctccctgatcatgtggaacgctctctacacggctgagaaggtcatcattcgatggaccctgctcaccgaagcttgctattt

SEQ ID NO: 22357 - DNA, 708 bp, Homo sapiens
  ENST00000531130
agtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaatgctgcgcccacaccccggcctctgatgaagctctctgctggggatgtgctgccatcttgtggccattggtggaatacacccagtgggttggagcttgcagtcgccaccatctgcaaggagcgctcataagcatctccctgatcatgtggaacgctctctacacggctgagaa

SEQ ID NO: 22358 - DNA, 1078 bp, Homo sapiens
  ENST00000531928
gccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggtctggaagctgggtaggaactgtggcctgaggccggtgtctcccctcagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacaccca

SEQ ID NO: 22359 - DNA, 586 bp, Homo sapiens
  ENST00000525667
cttctctggctcaccagaggtgcctcctccatcctggcccctcgtgcaggggcccatctgtcaggctctggggctgcctccgagaacctgactcctacactgccacgcctgtgccttctccaggagcacactagatcccatggcgcttgccttccctgaccagctctatgatgcggtctttgatggagcccaggtgaccagcaagacccccatccgcctctacggcggtgccctcctcagtgagtactgctggggcgggccctgggggaggcgacgggcagctgggagacccagcggggctgaggagagcacgggggtccgtgcccgggcaccccttcctttcttcggccagatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtc

SEQ ID NO: 22360 - DNA, 1061 bp, Homo sapiens
  ENST00000532921
ccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggtgagcccccacccccagcccctgagatctggccccgtgtggctccctcagcccttctctggctcaccagaggtgcctcctccatcctggcccctcgtgcaggggcccatctgtcaggctctggggctgcctccgagaacctgactcctacactgccacgcctgtgccttctccaggagcacactagatcccatggtttgtggcctgactccttctcccaggaaccctggagttttctgtcctggcatgggggcgggtggggacaattgggtccagaccctggactgcccccaaggatgctgatcctgctcctggcggggaaggaagacgtctgtgggaagcatcagctgtcaccccccaccctctcccaagcgggacctctgagcccctctcgctgcccgcaggcgcttgccttccctgaccagctctatgatgcggtctttgatggagcccaggtgaccagcaagacccccatccgcctctacggcggtgccctcctcagtgagtactgctggggcgggccctgggggaggcgacgggcagctgggagacccagcggggctgaggagagcacgggggtccgtgcccgggcaccccttcctttcttcggccagatgctgcgcccacaccccggcc

SEQ ID NO: 22361 - DNA, 720 bp, Homo sapiens
  ENST00000525145
cggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggtgagcccccacccccagcccctgagatctggccccgtgtggctccctcagcccttctctggctcaccagaggtgcctcctccatcctggcccctcgtgcaggggcccatctgtcaggctctggggctgcctccgagaacctgactcctacactgccacgcctgtgccttctccaggagcacactagatcccatggcgcttgccttccctgaccagctctatgatgcggtctttgatggagcccaggtgaccagcaagacccccatccgcctctacggcggtgccctcctc

SEQ ID NO: 22362 - DNA, 556 bp, Homo sapiens
  ENST00000525683
gtgcactccttctttctctctccaccagcacgtctgcgaggaagtgggaatgatggctccatttcacagatgaggaaaccgagactcagagcacaaggccacacagcaggaagagggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgacc

SEQ ID NO: 22363 - DNA, 499 bp, Homo sapiens
  ENST00000525138
cccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagccca

SEQ ID NO: 22364 - DNA, 642 bp, Homo sapiens
  ENST00000533443
agagtcgaaaaggacaggaattcttcatgttctgcccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacaggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatg

SEQ ID NO: 22365 - DNA, 602 bp, Homo sapiens
  ENST00000530035
cgcgggccgccagactcggtaagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatg

SEQ ID NO: 22366 - DNA, 533 bp, Homo sapiens
  ENST00000527685
agagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttct

SEQ ID NO: 22367 - DNA, 571 bp, Homo sapiens
  ENST00000533937
attgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtggggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcag

SEQ ID NO: 22368 - DNA, 3567 bp, Homo sapiens
  ENST00000616990
attacacacttgggtatcaccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 22369 - DNA, 3683 bp, Homo sapiens
  ENST00000308212
attacacacttgggtatcaccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 22370 - DNA, 195 bp, Homo sapiens
  ENST00000627720
atggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcgcttgccttccctga

SEQ ID NO: 22371 - DNA, 3675 bp, Homo sapiens
  ENST00000264811
aattaacttctcttagtcttcaagcctagtacttgaatgtcaagtacctgcaagcctcaatgtccaagacttttaagagcggaaggtacgatgagttccatctttactagggtcacaaggaaggcatgggtatatggaaatttttattattattccatctgaatatcattttctagagaataggagcttttgttctgaagggctgccggcttccttctgggatctagcagccagggttagatcacaggtgtcactttcaggcgagtagttagcaacggtatcgctagcaactgagccgacccctgcagccagaggtttgcagtgggtagtgtgtattccagaaagggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatata

SEQ ID NO: 22372 - DNA, 3548 bp, Homo sapiens
  ENST00000379645
gggaagactgcactgccgcgaaggcggaggaggccggcagccggcacccccacactcggaccgcagccggcgcgatgtccaccaaggtcaggaagtgcaaagaacaagcaagggtgaccttcccggcgccggaggaggaggaagacgagggcgaggacgagggcgcggagccgcagcgccgccgccggggctggaggggcgtcaacggggggctggagccgcgctcggcgccctcgcagcgggagccgcacggctactgcccgccgcccttctcccacgggccggacctgtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatat

SEQ ID NO: 22373 - DNA, 2700 bp, Homo sapiens
  ENST00000506449
gggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagatctcagagcaagttgaaaactccaaattccgtttagagacagtagaaaagcatttagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggc

SEQ ID NO: 22374 - DNA, 2382 bp, Homo sapiens
  ENST00000513531
atggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatga

SEQ ID NO: 22375 - DNA, 619 bp, Homo sapiens
  ENST00000502968
cgtctctctgtggttcagtcacatttggggtaaaactggaaccgaagccctatagggtcccctgagggagagagtgggcatcgggcagccggggaaccgctttagtgataactttgactgcggttcccaggcggtgcagggtcagcggctcgcgccccggcgcgcgggctctctttttctctttctttctttccctctctctctttctaaacgaaggagcggtcggcgcgctaatgcatgagaaagagcaacttttcttaatttccaatcttggagacagcttttaatcagtgcgagacgcagagaagataaaaagagggtgatcggtttcacagggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctg

SEQ ID NO: 22376 - DNA, 5839 bp, Homo sapiens
  ENST00000262839
accccacatcacaaccacgacgggttgtccgcagctcgcagccaccccaaagggaggaataaagaacaggagcagagggaagccgggcgcagaaagaagggaaaaggaagagctcagggttggacatttttggagacaggggtggggaggataaagggagcgtgcctccttgattttcccctccccacccctctttgcttttctctccccttctctgtatagcatattccagaaacggcagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctcttattgtgtgtgactggctgcgtgaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcaggatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtttcatttggggtgagattaaggaaatgtgggatggtggatttactgaatacatccatgactggtggaacctgatggattttgcaatgaactccctctacctggcaactatttccctgaagattgtggcctatgtcaagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagaacgcaatgctgacagcctgatacaaaatcaacattatcaggaagttatcaggaatttagtcaaaagatatgtggctgctatgataagaaattccaaaacacatgagggacttacagaagaaaattttaaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacatttgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcttcgctaagactgtcataaaatggccttgacatttaatcacaggttactttccagaaaggtttctaaagttacagattcagcttttcaaattgtcaaattcactttgaataataatagaacctgggctacattcctaactcatattaacagca

SEQ ID NO: 22377 - DNA, 4612 bp, Homo sapiens
  ENST00000344327
gggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaata

SEQ ID NO: 22378 - DNA, 2648 bp, Homo sapiens
  ENST00000532133
gccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaatagccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatg

SEQ ID NO: 22379 - DNA, 2448 bp, Homo sapiens
  ENST00000348423
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 22380 - DNA, 2631 bp, Homo sapiens
  ENST00000360497
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaaatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 22381 - DNA, 645 bp, Homo sapiens
  ENST00000532184
ctttttttgaaactgaattctgctccaccacagtcttaccctggtgtttctgcaggatccacatcagaccctgcttcaggtgtggatgtcttagttaatcaggtggcactgttgatcccccatcaatggacttctgagatcaccaccattatttcctcaatttgtttgactctttctctaccatgcattcatctgtgagaaggttaacgcgtgattctcatgacaacgtgattggcagccacaaagtctaagagactcctcagacaacctctaacaaacagccattaacaaactgaacacacctaaaatgtcactgatttgtcttggaagacagaatactaagcaagataaatggcactatacatatagataatttgtgtatgtaagactattagttcattagataactaatctcactactttatttaaaagaaaatgtaagtaggaatccatttctaaatcttttcaaattacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggtgagttga

SEQ ID NO: 22382 - DNA, 425 bp, Homo sapiens
  ENST00000527240
agtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaagtaaggtcaggcgtgaagcccgtttacattattttggttcttgttggtgctaaataaggataaagggttgatattgttagattaagctgggattttcttttcttttctctttttttttttttgagatggagtctcgctctgtcgcccagtctggagtgcagtggtgcgatctcgg

SEQ ID NO: 22383 - DNA, 359 bp, Homo sapiens
  ENST00000526713
cagatctgcactagtagtggcagttagtccggttcaattgctaaaaaagaccctcaggatccaattcctaaacctattaaatttcttgttatttagtgactttatcacagaggggcttaggaatatgttccaggttgtcaggaaaaaagagcataattttctttttctttcatttcgcagatggaggaacagattgcctggttggcttacaagacacctagcctgcaagtggcagagtcacgatttcaatgcagccctgtcggagccggggatctgacaacagactggctcaccggcggcagacagttctccgtgagaaggggagaaggttagctaatcgaggaccagcatacatgttt

SEQ ID NO: 22384 - DNA, 2424 bp, Homo sapiens
  ENST00000502753
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 22385 - DNA, 2406 bp, Homo sapiens
  ENST00000378459
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 22386 - DNA, 2241 bp, Homo sapiens
  ENST00000352189
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 22387 - DNA, 2024 bp, Homo sapiens
  ENST00000514963
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 22388 - DNA, 2987 bp, Homo sapiens
  ENST00000513104
acagatgcttctccgtcatgttctctgggaaatttccccccgattaggaaaaggacggtaacacggttctgcctcggaaggcgagtttttaccactgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaagggg

SEQ ID NO: 22389 - DNA, 817 bp, Homo sapiens
  ENST00000509288
attgtgcatggttttagtgagagcaaactccccttctctgtgccatctgtagaaaaactacaccaagtcctgcttagaagtctgctttccgaatgttggggctgtgtctctgctcctcaggttgggctccgttgttaaatcgtggcctttgagggtgtgttgttgtttcccttgttccacaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtcc

SEQ ID NO: 22390 - DNA, 2605 bp, Homo sapiens
  ENST00000503275
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaaggtacagactgcttaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 22391 - DNA, 5989 bp, Homo sapiens
  ENST00000300482
tgcaccgggcacgcggcgcacgctcgggcgagatgtggatggccccgcggggccagggcggcggtgctgcgcggggacgcgggtgacgccggggcgcgggcggctccgagcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 22392 - DNA, 582 bp, Homo sapiens
  ENST00000431901
gcgcgagcccgggtgcggggactgaggcggccgtcccgggagcttgtgaagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccg

SEQ ID NO: 22393 - DNA, 6221 bp, Homo sapiens
  ENST00000397928
tgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 22394 - DNA, 5216 bp, Homo sapiens
  ENST00000397932
tgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcagggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataa

SEQ ID NO: 22395 - DNA, 5627 bp, Homo sapiens
  ENST00000300481
tgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 22396 - DNA, 5228 bp, Homo sapiens
  ENST00000498430
gggtgtcaggtgcccctcagtgctgtggggcctgcccacccgtgctccttccccaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 22397 - DNA, 904 bp, Homo sapiens
  ENST00000490982
aggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggc

SEQ ID NO: 22398 - DNA, 1669 bp, Homo sapiens
  ENST00000621064
agccctgcactggatcgtgaggacgctgcgggccagcggcttcagctcggaggcggacgtccccactctggcctcccagaaggccgcggaggagccggatgctgagccgggagcaggaagaagacggaggagccgggcgacagtaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 22399 - DNA, 5050 bp, Homo sapiens
  ENST00000381913
agggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaagacaaaaagcttttcttcacacacacaaaagtctgcatgagacactccgggcaagtcctgctgggccgccgcgatctgggtgaaaggtcctggctcttttcctcgtcctgacctcacagtagcgcgtgcctgtgtgctgggatcgtggctttcgctgaagcagaaatagcagctgctcgatcgatatcatcttggaactcagcagttagtcgcatacctcagtatgtctcagtgggggaatttaacaaaatgcctcaactgctttggtacgaagtattttttttttaattttaactgtgaattttgaagctgaaggggaagcttgtgagagaaaagcatttgccaagactttgagcttatttttaggtcctcgtcctctgatgttctctttctgaaatgacacggagtcagtctggggggcagaggtgaagtggagacggaaggattttccaggtgactggggccgaaaccaccagaaaatccactctgccgccgttatctggtgaaaggattcatgtaaaaatgttcgaggtggaattataaaaatagtaaccataaatgttaatcttaaatggcagaaatagaaatttggccttcagataacatggcgatagataagttcatctggcttgaggcaaactgaagagtcggggcctagcagtgcactctgggccagtttctctgccctgggccactctgtgtgccagactagctggacagatagagactttgtgcccctgatggggccgattggggagaggtgggctggggtgtgtgaggcttcacaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtta

SEQ ID NO: 22400 - DNA, 1621 bp, Homo sapiens
  ENST00000577016
atgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaa

SEQ ID NO: 22401 - DNA, 3235 bp, Homo sapiens
  ENST00000301365
tccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaa

SEQ ID NO: 22402 - DNA, 2726 bp, Homo sapiens
  ENST00000571139
gcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtagacacagggttttgccgcattggcctcaaactcctgacctcaactgatctgcccactttgacctcccagagggctgggattacaggcatgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtcc

SEQ ID NO: 22403 - DNA, 2744 bp, Homo sapiens
  ENST00000573539
gcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtagacacagggttttgccgcattggcctcaaactcctgacctcaactgatctgcccactttgacctcccagagggctgggattacaggcatgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaaggttctcactctgttgggcaggctggagtgcagtggcgcgaccacgactcgctgcagccttgacctccctgggctcagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtcc

SEQ ID NO: 22404 - DNA, 2766 bp, Homo sapiens
  ENST00000576742
ccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcaga

SEQ ID NO: 22405 - DNA, 2937 bp, Homo sapiens
  ENST00000572519
tccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacaggtactgtcgctgtgaggtgacatggtgtccgctcctgtctcagaccatgtaaccttgggcagatcaagtctaagggtcctgactttccccatctgtcaaatgggagggttgaatggaaatgcttcttaggtctcttccagctctgacttttagaaccctagttggcacaacttttaaaatggcgtagccctaagccatagaaacacatcatgcaggccgggcgcggtggctcgtgcctgtaatcccagcactttgggaggacgagtcgggtgaatcacctgaggtcaggagtttgagaccagcctggccaacatggtgacaccttgtctctactaaagatacaaaaattagccgaacgtggtggcaggtgcctataatcccagctactcgagaggctgagtcaggagaattgcttgaacctgggaggtggaggttgcagtgagctgagatcacaccactgcactgcagcctgggtgacaagagggaaactccatctcaaaaaagaaaaaaaagaaaaagaaaaaaga

SEQ ID NO: 22406 - DNA, 547 bp, Homo sapiens
  ENST00000571005
gttggccttaagcccctgttctgcagctgatggttgttcctcctcctgtcccagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatg

SEQ ID NO: 22407 - DNA, 675 bp, Homo sapiens
  ENST00000575865
catcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagaggtaagtgggccacccggcccttccagaccgccccgcgaggcaggcaggtgacagcctccatccctctctgctctgccattactgctggggggttctggggaggcgtttccttcccaagccttacctttctgagttataacatgggaaaaaatggataaggctggcctatcctacctacttcatccatctacttctctatccatctgcccaactatccgccatttatctaccttcccagccactcagtgtcccttgtcctcttccacccccatccacccatccgatcacctgccctctttcatggacccagccactcattcatccattc

SEQ ID NO: 22408 - DNA, 2773 bp, Homo sapiens
  ENST00000574773
ttccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagaggtgggtttggagagctcgggacacggactgcggcactgtgaggggcacgagtgggggcctggcacccccccagggagcccttgccttggggagacctgagactctcagtctcgcccggggtggcccggtgcccggcgaggtatgactaggggatggtgcggtggggagcacagcacactcagggggctgagctggggtagtcagtgtgactggcacaattagggaagcctccttggagggatcgggggtgctgaggcaggagcagtcaggagggctcctgagggaggtgagggatggctggagccacccttgagacgaggagcaaaatgctggctggaagttccaggtgacccggagcctctgttgggcacgttttccacacacacacccatggctttccatccactctgcacccagccgggttattcaagctcttgaactccacctttggaatggggacaccggcaatggcaccaactataggatgatggttaattgggatcaagtcaacaaagtgctcagtgcagcgcctggcacgcggtcagcgctcagcatgtgttggcattgagagtgtttctgtgaccttcaccatcatcattgtcctcatcactccacggagcccctgggaactgggcagggctgggatgatcagctttacttcttcgctggggacgtggaggagacctggagcagagaaaggacctctctagggtcacccatcccgcccctccgctgcctccattatagattctgcacccccagctcattgggtgcctctcacgctgtcccccagcccacttcacctgtgcgtcccttgaacccggggtggccctgcctcctctgcctgtatcccaggccccctttgggccagggctgagcttggtgcttcccctctgttagttggagctataatcattgaggtgtcctgtgtaccagccccagggttgggctcaggataaggagtttgggacatggagagaaaaatgcccacgtctgctcacagtctggtgaaaggggagtcgaggagagagtgggaagtgaccacagagaggtgaactagccccgtggggcctgaagagtggcaggttattctgatcctgtaggcagtctcaggggacttcctggaggaggtggtgctagagaggatgtggagaggaaggaaaaagtgcatctgggcagagggacatgagagccatggctcagagtggggccactgaggtgaggagtctggtgtagctgaagtaccggccagtagaggagtctttggggaggcgagtcccactggagctgagtcctgggggtcagtcaaggaacttggataatcctcagggcagtggggagccatggagggattttttgtgggagggagggcatggtgagatgtgccttctggagaggtgactctgggggatctgcgtggatgacggattagaggagaggctgacagcagggagaccatgaggaggcctttgggaagcccaggtgataggtggtgatgtctgagcctgggtggtcacggataaagaggagggggcagcacagacaggtgccagtatcatggggtctgcaggaccagccacgggaggtaaaggagaaggaggagtcccggtgggagggcctggagggatggcggggccatctgacatggcgcatcagaggagaagatccaggtcaggaggaatgagccaaattcagttgtgaaatgttgggtgggaggtgcctgagagacacccaggtggaggctccatcttggaaggcaaaagggaaaactggtggagaaggagccagacaggtgtcgtgtggggtcatgggggcagcctgggtctgggtgggcttgtccaggaaagggcagagacatccctgagctaagctggcaaggaccacctccctggctctcctgccccttcccatccgctctcacttgtccaggggaggtttggacctccggaaaaaaatgaggatagagttttgggaaaatcccacgtcctttcctcagcaggaaccgtcaggctgccttctctgagcccatcccccccattcacagatttagctccaggctcagctctgcaaagcctcctccgcccagccaagggctgagcttggcatgtctcctaaattgctgtccacttctctgccccaaaggccctctgaggaccctcatgtgaaggtttgggcacccccctcagagctgagtcggggacttgggcccagagagaaacagaaaagaataaattaaaaggccgggcgcggtggctcacgcctgtaatcccagcactttgggaggccgaggcgggtggatcatttgaggtcaggagtttgagaccagcctggccaacgtggtgaaatcctgtctctactaaaaatacaaaaattagccgggtgtggtggcgtgtgcctatagtcccagttacttgggaggctgaggcaggagaattgcttgaacccaggaggtggaggttgcagtgagccaagattgtgccactgcactccagcctgggcgacagagcaaaactcttgtctc

SEQ ID NO: 22409 - DNA, 5742 bp, Homo sapiens
  ENST00000616411
atgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaagacaaaaagcttttcttcacacacacaaaagtctgcatgagacactccgggcaagtcctgctgggccgccgcgatctgggtgaaaggtcctggctcttttcctcgtcctgacctcacagtagcgcgtgcctgtgtgctgggatcgtggctttcgctgaagcagaaatagcagctgctcgatcgatatcatcttggaactcagcagttagtcgcatacctcagtatgtctcagtgggggaatttaacaaaatgcctcaactgctttggtacgaagtattttttttttaattttaactgtgaattttgaagctgaaggggaagcttgtgagagaaaagcatttgccaagactttgagcttatttttaggtcctcgtcctctgatgttctctttctgaaatgacacggagtcagtctggggggcagaggtgaagtggagacggaaggattttccaggtgactggggccgaaaccaccagaaaatccactctgccgccgttatctggtgaaaggattcatgtaaaaatgttcgaggtggaattataaaaatagtaaccataaatgttaatcttaaatggcagaaatagaaatttggccttcagataacatggcgatagataagttcatctggcttgaggcaaactgaagagtcggggcctagcagtgcactctgggccagtttctctgccctgggccactctgtgtgccagactagctggacagatagagactttgtgcccctgatggggccgattggggagaggtgggctggggtgtgtgaggcttcacaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtt

SEQ ID NO: 22410 - DNA, 2928 bp, Homo sapiens
  ENST00000359396
agacaggccagccctgcagagtcctggctggctctgccaagtgtaacaaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgccca

SEQ ID NO: 22411 - DNA, 2406 bp, Homo sapiens
  ENST00000485138
ctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcaggtaatcatctgtccaggaccaggggccatggcagggaagagatgaggaagtctagggggcactggctctggctaaacttggggaggaggagtaatgcagagatcagaggagacctatggtatcagaggatgggacgtcctccagaggtgagaaaaatcgggagtgttagggagaggtggctcttaggatcaagatgaggctcatacaaaactagggaccgtaaaaacccaaagtttggagcactgcagagctggtgatattgagatgaagggaccaggatggacatgcacgcagagcccggggtgggctggtcgtctgcatggttgccatggtaaccctcacccccttgggtggagcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccc

SEQ ID NO: 22412 - DNA, 10433 bp, Homo sapiens
  ENST00000615386
ggtaaggcccccttggtctgctcccttccccacctccccaggcctgcacctctacccctcacccctccctcacctcccgtctttgtttggcacctttggctggacagatggtgctcccaggcccggactggctccttgggagcattctgtcttaagagcctcagcctgtagggctggtgaaagaggatggggttgagatgggcacaggtgttcactatcttaagatctaattcgattctgcaagcctcttgtgagtacttctctaagggccaggcgtcttgctggggcttgtaaggatagagcatcacagcccctccacccaagaggggacggcaggtgaggacaatgccttctgtatctccactgcttgcctctagaacagtctctctggcaggaacacatagtatacatatgttcgcatggaggaatgagtgaacgattgaatgaatgaagcagagagaaccgcggacaccaggaaccagaaaataagacaaaatgtgaaaaaagtgaccattcctatgtatctgtctcatcagacactgaccaaggccttactatttgcccagcactggggggatatgaagacctacaacgctcaaacccaaccttgaggtgtatttctctctcagtgcgggtggggactgaggggaagcgggtcaaaataacagatgttccgaggacctgtgctcttccgcattcaggtggtggaaatcgagactctagcgtttaagccctaaggacattcactggtggcttccagcccctgaaaacttcctaaacccgtgtcctgctttcttcaccatgacagcttggagtacagagcaggagaggagcagggaatcggaactcagggctatccctgcatgtggtctcttcttcaaggtctctaatagagttctctacccagttggtggcatgctagaaggaagtcctgcctgttggggctttccctgggtcacgaaggaggcagatgtctggtcatagaggaaagcctgaagtctttgtgccttagggtttttctctgaccccaagagtaggagcctgctttagcctgaccggggaggctgcctggaggcccctgtgttttcttttgctgaaggattctgggttggggatggtctctttctgtgaattatggcttcccatctctccagccgcccacctctcccccaaggcctgggagagtggggactggagcacatgtttggctgatgacatcttggggcaacagaatggcattgttgttagagagtaggtcgtcctcactggcttcactcatcctcttcccactcttaggaccccagggccaggggatccaggcacagagtgcaaaaaggcctgggggattggaaggggtggtggagattccctgtgtgcgatatcaggggagagcagaggggaggccctgcgctgagtggctgagaataggctgcttccgcatgtcctgtctgccctcacttttcctcagatcatatgggggctgcctctgcagactttggctagaaaggcttgatgtcacccttgggagggatcccccctccctgccctgatctccttactggcctccgcactttcttggccttcttcttgctggatatcaggtgtccagagcaatgactcttctttgggtgggcacttcccagaaggatgctgaaattgcctgcaaggggagtttcctaatctgtgccgtcaaccaaagagaaggcatgggggcattgagataaacatgggatgactaagtaaataggaacaatatggacaagtgaggggtgagctaatggaagaaaggagcacacaatgattgagaacccagtgctgtactaggtactaccacctgccttatctccgtcatcccggtaacaataatggaaggtgggtcctgttatccccctatgaatggggcaggcccagaaccctagagcaagtaaatggtgaagttgaatttgttccaaaggggactcacagggagaactgtggggtgggattgcgtgggattccatgcggtacaggatggtctagtgagaaaggaaggctttgagtctctccaggatgatcgggaacccaaactcctctttttacagtggacgtttcttggtgcttagcacgcagcccgctctgcttaaatctacattgctgggatccaagtcgagctctcaactttctcccgtgtcctccaggtcatctcccccttgggcttgggttttctcacttcctgatatttaatgcattacacatttattgaacataaggcactccacctttctgcagaaaatgaatatgacactgttcctgctctcagggagttctcattcctatgaccaaagtttactgaaggcacatacggggctaaagatgggcttagtagacatcactagaagggtgtaaatgagtgttctggaagcatagagggggaagtgtgagatctgatttcggctgctgtggggtgtcctgggcagcttcatagaggctgcttaacctgaaccccactccagcccatgtgctggcactttgtcatctaaggagcaatttggagggaaggtgatgcttgttggagctttttttagggttaaatacctgtatgaaatgtgtgaattgagtgtctgaaaagtcatccctgggtttctctggtatattgtgcacgcttgccttggtaaatacttacacacatgcctacttgtaaatgcgcaaatagacatgtgcacaaaaggagctgtggcacttaggatggcagccgattccaaatctctaaacaaccactttggctttctcatccccattgccaggaacatgagctggagggaggtggcccacaagtgcccaatgtatgcctccgccccacacattaccgctctttccttcatctgtggtcactgctcaggcttgccccccaacctccaagaaaaatcaggaggagccataaaactagaagaaccacataatttagtggtcagagcctggggctggattcttggccaagcatcctgcctttaactccgtgtgatcttctggcaatgatttggttatgccgcttcagtttccttttctgaagcatgggagaactattcagctggtgttagaaggttgtaaagagcaaaagtgataatgagtgagatgctgcgggaatgagaggggccatgaacttcccctgcacagcactgtatccacccaggaatgcaagaagccacgcactccgagcaaccctgttatgtaccagccccagccctgcccagagggtacactcactggtgggaaaggtatttgtggagagaccagtgggacccatgcctgtcttctctaactcctcttccagccctgattaaaactgagaatcgtgaccaagaaatgaccagtggggcatgcgtcgtggctctgtctctgacttgcttcctccatctgtttcatgagcagatttgactcagtttctgaggggctttctagctctaaaaatcttatttgaacttttctcaagagtcttgtgatcctgccttgtttctcagcacctaaaaaccaaattggacccatgcacacagtgcacacatctacaaggatggaggagcagatgagggtgtggggcggaggagacggagagaggaagtcaggaatccttccctggtggcccagaggcagccctgagaaggaggtcattgatctgtttgctcaagaaataatgtgctagattttgtgccaggaaccccttagttgggttttcaccaggctaatgttgaactagaccgttcaattttattataattaattgcctagtaaaagaaaacattctagaacctgaaaatacctttcatattgttacagtttcagatttgctctataatctcttttgactacttcatcagtgggagcttaaaaggcttcatctgacttttttttgtttctcccttagttgagtatttagtgatccataagaaaacatttttatgtataggatatttctgattccttttcgagtgaagaatcctcattctaaaacggattatgaatcattgtacctctgaatcaggggttctccaccttggactattgacattttggacaggataattctttgcagtgagggctgtcatgtgcagggtgcttagccgtgtccctgcctttgacccccgtgttgtgatctaaactcctgtgataagttgctattgaaaaatctatttgtcccccaagcacaggaatctttgagtaggtcagctctgtgcacctccttcagggacccaaggagagtcaggtgttttggggtcagccttactcccaagcaggtgagctagggctttctgtgctgtccccttgtgggcatatgaggttattgcaagtaatggctgggccggataccttcaaaacccgtccacaggctgggcccccctttttgctggagtctggagttcacagtcggaggaggctagttctctacaaaccttgctgggttgggtcataagctggctcttcacgcagggtgtggtctggctaggttgccagataaaatgcaggacactcagttcaatttaaatttgagataacgaataggctgctagtataagtgtatccccaatattgcacgtgacatacttatactaaaaaaaaattgtgcatctgacattcaaatctaactgagcatcctgtatttttatttggtaactctagcaactctgggtctgacagtagctttttgttttccccaggccactagagtgtcagaattcatagggaatggaggtttatgggggacactttcagcttcagagacgtgtagggaccaaaggggaatctttgagcctgccactgactataccaccactaacatctaggatacagcgagtagaactctggacttggaaaaggtgctctctcggacccatttctagatttgccatcaatctttcacacatttggtcaaaatgggacacaaacgtggaagcatattggaggagggcagggaagagttagtggctggtctcttccctcgagtacccttagcatagaggaagggacacagatacatagcaattacagcacccagtgaaagatgctgaaataaaagtaaggccacaggagagagtgaagaacttctgagtgtctgtgtgtgtgtatgtggtgctagcgattgttttcccctcagtctagggtatctagagaggagggctttgtgcaaatggttgatgtggtggtggtgatggagggaatgtggaaaacttgttttgaagctgtgtttgcataccaagtgtactatttttcacttatatgcttgctgaaagttggcttagcgggcagctgatgaaaataataataacagttaattcaaaccaccttttggcattgctgctgattcattcactctacagatggtgtcagtgagcatctacaccatcctaggtgtatttctaggcataggcagtgcagaagacacaatgaacaattggcgggctgggggagttggattctagaaggaaagagcttcatgggcacagacatagggagaatggtgtgctctgcagtgctgagacaggatgagaccaaaatgccaggtctaaggagtgggtgggacgtgcagagggtggaaaagtagttgcacaaagaccttaaagagcttctgtgttccttatccttagcattttgctaatctgggctagagaatgaagacttgaattaatgagggttagcaggagcaaggaggtagggactgaatgaagagagagctttccatgctgaactgacaggacctggtggcagctgctgtgcatgggggcaaggcagaggagatgagtgagctgatgtctcctctctgattgccctcccacctccagctctggagtcaatttcttgccactgccagcgctttagaatgtgagctcctgtctatgtctttttgtatgtcacataattgtcaaactatggataaatagagttatttcatttactcccatagaaagaccaaatggctccaggccaagagaaaattgaatcaaagggacccatgtgtcttagttggggtaagttctaattttaaaagagatttttagcacacagtaggtataagaataaagagatgatctggggattcagagaagataattttgcctaaaacaagcgagaagtggataataaggagagactaatctgactcagcaaaataaacggatccatgaatcccaaattgggtaaatccaggaagggtccgaagacagaatgggaacattcagatgcacatgaaattcgatgaatgaatcctctagattggattctcttttttctctgcatctgtcattgttggccatagtttgtgtcttaggggccaatagccgaaacaaagtagtatctaaagccctctagacagctggtctgaaaatgatggagaacactgtttcgcaaactttaatgtgagctgtttggaaactgagacccctgagcttgtctctgatttatcgccaccggtttttgcatgcaaggaccacttaagcaatgcttctccaactttcatatgcccaggaatcagctggaaatcttcttaaactgcagatttggattcactaggtggaagggtccgccagagcatttccatttcttataagggctcatgtgctgctgctgatccaggggtccactttaagaaggaaggctgttgagatgatgtgagaagaaagacgagaggcagaaaggaagagacagagataatgaatgaatgaatgaatgaatgaatgaatgaacacctatgaggaaggaaggcctggagccaggcttgttcttatggtccactgttcttttgtgttaagccctgaagatgctattgttgggagggaagcgccaggatcaaagggttctgctgagaaggttgagtaggcagaggatggtgcaacaggagaaatcctgctagcctgtgcatatgactccctccacaaatatgagacaggaattccttgcacccctcggtccatgcaaaacaaggcttatcctggagggcaatctcagggcacctggtgagggtcaaacaggaccactccaggggtaaactggttagcaggtaagcacatgtctacatagaactcctcccctccgtacctgaaatgcactgataatacattcacacatgatacattctggtcccaggacccggtaggggggaaggaaaccagtcacggacaatctcaaaacgcatgctaaatgggcaaaaagttgattgtatttactgactgtaaagagaaaagacatcaatggccccacctgccttgattgaagaccctgaggttcctgctgctgaggcacacacatctgtgtataataatggagtcaagccagggcctctccctccacaactaggtatgctcactgtttccagctttcctattccatcccttcataggatctgggagtctcctctccttctagctgccaaagataatgatgtccaggccctgaacaagttgctcaagtatgaggattgcaaggtgcaccagagaggtaagaagcacaaatgcagcatgatctcctaggtgagccccacacatggggcctcccaggagtgcccaggacctcgtgctgttggcctctgaatctatcgtctccaatccgctgtcccacagaagccatataacccacctctctgtaaatgccaggagccatgggggaaacagcgctacacatagcagccctctatgacaacctggaggccgccatggtgctgatggaggctgccccggagctggtctttgagcccatgacatctgagctctatgagggtgagggcccacgggtctggggtgaagagcaggagtgactggttgggtatttcaagtcagtctctgtgatggataatttgggaaagacacaggggatctgagcctcctactctttttttctcttctctgtctcccttccgtgtcagtcctgactgcccatcactagaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcgga

SEQ ID NO: 22413 - DNA, 1806 bp, Homo sapiens
  ENST00000619250
ccctttcaagctggctggagtggagggtaacactgtggtgagagacggtccccatccctgaggtgtctttctaatgaccctcaacctatcccgctggccctgggagaaacagaggtgaacgcgatccctgatgcttagatcccattctcaactcagaaatttttcaacccctcccactgtggttacctgttccctttcttgcccactccttttcccctgaggcattgggggttacagagtctagatcccatgctaggattgtctgtaatgccccagcccaccttccctttcagcccccagagcagggccctccagcctctcgtctctcctttccaaactctggagggagtcatgggagaggatgaggaacctatgaatgtcactgtgaatgtgggttcttctgccctctaaaggctgtcatcaaaatgaaagggcagccaccttctccaggggtgccgtcctcctgcacatgcatcctatccacactctgtgaccgtcccctttgcttactgctcctgagtcatcttcactttcccttagatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatgtgagtttccttcctctcactcccatcccttccctcaacagggctccagttccactccttggattcctgacctctcaagaaccttagctccagagccccctctctagtgctgtgtgtatgaccctgggcattgagtgtggggaggctgaatctgcatgtgtgggtactttcccagctacattcttgctgtcaggtccccaggatcatcccagccctcccctcatcaccctcctccctgctcccccagcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcaggtaatcatctgtccaggaccaggggccatggcagggaagagatgaggaagtctagggggcactggctctggctaaacttggggaggaggagtaatgcagagatcagaggagacctatggtatcagaggatgggacgtcctccagaggtgagaaaaatcgggagtgttagggagaggtggctcttaggatcaagatgaggctcatacaaaactagggaccgtaaaaacccaaagtttggagcactgcagagctggtgatattg

SEQ ID NO: 22414 - DNA, 532 bp, Homo sapiens
  ENST00000436401
agagtcctggctggctctgccaagtgtaacaaactcacagccctctccaaactggctggggctgctgggagactcccaaggaactcgtcaggaaggcaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtg

SEQ ID NO: 22415 - DNA, 540 bp, Homo sapiens
  ENST00000474388
gtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtggtgagagacggtccccatccctgaggtgtctttctaatgaccctcaacctatcccgctggccctgggagaaacagaggtgaacgcgatccctgatgcttagatcccattctcaactcagaaatttttcaacccctcccactgtggttacctgttccctttcttgcccactccttttcccctgaggcattgggggttacagagtctagatcccatgctaggattgtctgtaatgccccagcccaccttccctttcagcccccagagcagggccctccagcctctcgtctctcctt

SEQ ID NO: 22416 - DNA, 673 bp, Homo sapiens
  ENST00000489123
atgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtgagggcccacgggtctggggtgaagagcaggagtgactggttgggtatttcaagtcagtctctgtgatggataatttgggaaagacacaggggatctgagcctcctactctttttttctcttctctgtctcccttccgtgtcagtcctgactgcccatcactagaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttg

SEQ ID NO: 22417 - DNA, 247 bp, Homo sapiens
  ENST00000431833
aggccctgaacaagttgctcaagtatgaggattgcaaggtgcaccagagagaagccatataacccacctctctgtaaatgccaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacat

SEQ ID NO: 22418 - DNA, 2298 bp, Homo sapiens
  ENST00000638686
acgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctga

SEQ ID NO: 22419 - DNA, 2927 bp, Homo sapiens
  ENST00000611485
agacaggccagctctgcagagtcctggctggctctgccaagtgtaacaaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccccgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccaggttgtggccaccacggtgatgctggagcggaagctgcctcgctgcctgtggcctcgctccgggatctgcggacgggagtatggcctgggggaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctacgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccagccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgccca

SEQ ID NO: 22420 - DNA, 2405 bp, Homo sapiens
  ENST00000632381
ctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcaggtaatcatctgtccaggaccaggggccatggcagggaagagatgagaaagtctagggggcactggctctggctaaacttggggaggaggagtaatgcagagatcagaggagacctatggtatcagaggatgggacgtcctccagaggtgagaaaaatcgggagtgttagggagaggtggctcttaggatcaagatgaggctcatagaaaactagggaccgtaaaaacccaaagtttggagcactgcagagctggtgatattgagatgaagggaccaggatggacatgcacgcagagcccggggtgggctggtcgtctgcatggttgccatggtaaccctcacccccttgggtggagcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccaggttgtggccaccacggtgatgctggagcggaagctgcctcgctgcctgtggcctcgctccgggatctgcggacgggagtatggcctgggggaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctacgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccagccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccc

SEQ ID NO: 22421 - DNA, 3069 bp, Homo sapiens
  ENST00000632455
gatctgggagtctcctctccttctagctgccaaagataatgatgtccaggccctgaacaagttgctcaagtatgaggattgcaaggtgcaccagagaggtaagaagcacaaatgcagcatgatctcctaggtgagccccacacatggggcctcccaggagtgcccaggacctcgtgctgttggcctctgaatctatcgtctccaatccgctgtcccacagaagccatataacccacctctctgtaaatgccaggagccatgggggaaacagcgctacacatagcagccctctatgacaacctggaggccgccatggtgctgatggaggctgccccggagctggtctttgagcccatgacatctgagctctatgagggtgagggcccacgggtctggggtgaagagcaggaatgactggttgggtatttcaagtcagtctctgtgatggataatttgggaaagacacaggggatctgagcctcctactctttttttctcttctctgtctcccttccgtgtcagtcctgactgcccatcactagaacgcctgccccctgaaatgccaggggcctagagaagaggaagagatgggcagcagctggatcccctgggaatcctgaacacccgagggctccctgttctccatcccaggctacccctgagggaaagagactggggtgcatatgggagggaccccctgcaggatcctgggaacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccccgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccaggttgtggccaccacggtgatgctggagcggaagctgcctcgctgcctgtggcctcgctccgggatctgcggacgggagtatggcctgggggaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctacgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccagccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcgga

SEQ ID NO: 22422 - DNA, 2313 bp, Homo sapiens
  ENST00000632330
ctcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccaggttgtggccaccacggtgatgctggagcggaagctgcctcgctgcctgtggcctcgctccgggatctgcggacgggagtatggcctgggggaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctacgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccagccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcgga

SEQ ID NO: 22423 - DNA, 1806 bp, Homo sapiens
  ENST00000632149
ccctttcaagctggctggagtggagggtaacactgtggtgagagacggtccccatccctgaggtgtctttctaatgaccctcaacctatcccgctggccctgggagaaacagaggtgaacgcgatccctgatgcttagatcccattctcaactcagaaatttttcaacccctcccactgtggttacctgttccctttcttgcccactccttttcccctgaggcattgggggttacagagtctagatcccatgctaggattgtctgtaatgcctcagcccaccttccctttcagcccccagagcagggccctccagcctctcgtctcccctttccaaactctggagggagtcatgggagaggatgaggaacctatgaatgtcactgtgaatgtgggttcttctgccctctaaaggctgtcatcaaaatgaaagggcagccaccttctccaggggtgctgtcctcctgcacatgcatcctatccacactctgtgaccgtcccctttgcttactgctcctgagtcatcttcactttcccttagatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatgtgagttcccttcctctcactcccatcccttccctcaacagggctccagttccactccttggattcctgacctctcaagaaccttagctccagagccccctctctagtgctgtgtgtatgaccctgggcattgagtgtggggaggctgaatctgcatgtgtgggtactttcccagctacattcttgctgtcaggtccccaggatcatcccagccctcccctcatcaccctcctccctgctcccccagcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcaggtaatcatctgtccaggaccaggggccatggcagggaagagatgagaaagtctagggggcactggctctggctaaacttggggaggaggagtaatgcagagatcagaggagacctatggtatcagaggatgggacgtcctccagaggtgagaaaaatcgggagtgttagggagaggtggctcttaggatcaagatgaggctcatagaaaactagggaccgtaaaaacccaaagtttggagcactgcagagctggtgatattg

SEQ ID NO: 22424 - DNA, 532 bp, Homo sapiens
  ENST00000633318
agagtcctggctggctctgccaagtgtaacaaactcacagccctctccaaactggctggggctgctgggagactcccaaggaactcgtcaggaaggcaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtg

SEQ ID NO: 22425 - DNA, 540 bp, Homo sapiens
  ENST00000631384
gtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtggtgagagacggtccccatccctgaggtgtctttctaatgaccctcaacctatcccgctggccctgggagaaacagaggtgaacgcgatccctgatgcttagatcccattctcaactcagaaatttttcaacccctcccactgtggttacctgttccctttcttgcccactccttttcccctgaggcattgggggttacagagtctagatcccatgctaggattgtctgtaatgcctcagcccaccttccctttcagcccccagagcagggccctccagcctctcgtctcccctt

SEQ ID NO: 22426 - DNA, 673 bp, Homo sapiens
  ENST00000634074
atgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtgagggcccacgggtctggggtgaagagcaggaatgactggttgggtatttcaagtcagtctctgtgatggataatttgggaaagacacaggggatctgagcctcctactctttttttctcttctctgtctcccttccgtgtcagtcctgactgcccatcactagaacgcctgccccctgaaatgccaggggcctagagaagaggaagagatgggcagcagctggatcccctgggaatcctgaacacccgagggctccctgttctccatcccaggctacccctgagggaaagagactggggtgcatatgggagggaccccctgcaggatcctgggaacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccccgcaacctcatctactttggggagcaccctttg

SEQ ID NO: 22427 - DNA, 247 bp, Homo sapiens; identical to SEQ ID NO: 22417
  ENST00000633826

SEQ ID NO: 22428 - DNA, 11154 bp, Homo sapiens
  ENST00000361875
cccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttgtactcaatattcatattatgttagtgatacttaagtaggaaatccttgtctaccaaaacttttacttgaattcagaaaggtgcctgtagaaattaacatgcactgcatctgtagccagctagctaatcagagttaatgagaaccagtagttagttctccgtgttaaaagacttatttgaagtaaaaatttaatcagattagccacaaacaaacaaggcataaaattgggatgtacatgagattgccaaatattttctattctagttgtgctgcaagacattgaacaaaatgttaatgaataacattataaatcaaggaactaagtacataggcttgagtaagcaaccctaaggatgtgtagtaagattccaagtagagctgctacaggtgagatacttaatggaatgtgaaacttcactgttggactgttaaccgaaaaggtttgctggctgtgcccctccagtgctaactgtgacatgtgatatttaatacaggtggagaaaaactagtcttagaaatgggatttttgtgaaaatagattccattttgattctggggctggaaaaacacttcataaacaaagtaatagtctccaaggaaatgaataataaggtttaaaatggtaacagcagttattactacttttatattaagaaaaacagtagaaaaggagagaaaatatgggtagttcacagaagagataaatggcagtttctaaaggttcaacctctagtaacctaagaaatgcaaattaatgtttttggcgaattgtaataagtgtcctaagtagcaggacttaacatagaaagaaagacaggctttcctgtgtacttttagaaagtaatttggcagtatgtatctagagccttaaataataagctttccagtgtaacgacaggagaagatactcaactcatggtccattgttcaaaaatgcagaattattgtggtgtctgccctctgctttcccatcatcccctcccctcaaaatccaaactatccctactgtcaacccttcccccagctgattgtttaggatcttaagtaacttccaattcagctttggagatttagtctcctgctccaaatagttgtaaatattaactgattgagatcccaatttggaggcacagtcttacaggaatgccatctatctaattctgtcagtgtaatgcccatagagcaaggtcccacataagcttttctgttttaatttagccggtaaatcataagtagaaatttttctgatacggtaattgtctacaattcaaacctaactttccccaaataaaatttagtttgttccgatgtgatctcacagcttgccacaccaaaaacaaatagtaggggttaggaggcattaaataaacagtttccttaactcctgattgtccaaaatagctgaatttttccaattctatttataatatcctatgctaattagaagtattgagataacgttttataatcaagcctccagtgactggggatcacagctgccattattcacaagaattttcacaggtgaatgattatatttctccaagttgcaaactccagtaattcatggacctttttttaaaaaaaaaaaaagtcttaatagaaccagaatatctctgttcttgaaaatttatctttgcagaaccagaaatagctaattgtctggaaacaatttttaagatttgaagtcacatttttaaaagaagctttatggctcagtggcaagcactttgtgacatttctttaataatcctatgaaaaggacaaaacccagccctcaaaattgacaatttgaggacataataagccaactgataatgcagtgaggaatacttgttactatgtacagtcagggatggttttgtcagggtaggtttcctcaaaaacatgacacctgagtcttgaaggtcataagagccagagggaagggtgttccaagcacaagaaaagagaactcaatggcttaaaagtataaacaaggctcctagggcagccacagaattgcattggagacaggcaggcagtgacttccccactgacctagtattttggcatctattcagaaagcaagaatgatttattgaatggttttaagcaatgggatactatgctcaaattatgctggatgtgcacaattccagtggcagatgggaggtaggttagagtagctgaaactggaagctgagaaataatttaggagggatgacaatccggaaaataaatgaaagggcaaaattacataggcaattttgtgaaggtcatgaaggaagtttgtcttgggtctttctgtaccattttcctctccacaatgaacatcccattcccagtgtcaggtatcaggtgcctattttctttttttcttttttctttttttttttttttgagacagagtcttgctgtgctcaggctggagtgcagtggcaagatctcggctcactgcaacctccgcctcccaggttcaagcgattctcctgcctcagcctcctgagtagctgggattacaggcgtgtgccaccatgccaggctaatttttgtatttttagtagagacagggtttcaccatgttggccaggttggtcttgaactcctgacctcaagtcatctcccccgcccgcctgggcctcccaaagtgttgggattacaggcgtgagccaccgcacccagctgcctattttcttgtccctccaaaaaaagattaaagagtcccaactcatacttgaaagtttgactcggtcttttccttccaacagttataaatctgtgaaatgaaagtctttgtttccttaaagggatttcaagaatttaacaaaagggttggggaatggaacctttgctgtcactatgcctgtctctcaattctaccctaaaggtaaactaaatggaatccttttatggtgactaggattaggatgttgattccaaagcctttccctaaaatctattccttgctccctggaaaggataatacaggttctggcccccactgtaggtactgacagcccaaggcagaataggttttgctaggctttagccttttattctttgacataggtcagtcctgcaggcttcttttttctaagtctcctgcctatccaaaaccagaccttttctcccacctccttctgcttcaagcctcttaataatccatatttctattttctagcaatagtaatagtttattatttagtgatgtatacttgcaccccatttactccttttcaatatttcaggatacatctttgtcctgtatttctgtaccagttcacagaatttctacagcaagatccctttaaatgtatggctttccttcataggttgcaaggattactttatacaagtgctactgtaactatatcttttgtggagtacaattggtatgacatgctgtgttcatagatgaaaatgctaagtgaggcactctgaagcaagttaaagttcacagacattcttgcttgcccaccacccccccgaaccccgccatggaatcatcaaataagaaaaataagacagattttcagattggtgatggcaaagtaagacgctggtattttgcactggcgcagtccatttagttgttgaatttgttcagcatacctggatggtgagtgagttagctttatttttcattctcagcagggaaactgatagactaggcagtttggggaattttcccattgtctactgtcatgggtccatagtatttaagtttacagactacaacattgtccacagaagccatatttatccccttggagggaagggaaaggtgtgctaacttagatcataaaaacaactgaattttaaaacaaggcaaatgccacagttcaacttctccataaaaaagttaagttcatctctccattcttttgcatgcctacaatatttccatataacaactgtaaaatactcttgcctgctgcaatccaaatgttatccggatcacagttcttgctgtcatttcacaggcatgcaatgtatctatagataggtcatatcatacctgaggaagatcagagacagcaagggaacattttccccacacttgagatggaaataataacaggtcagtggctaataaaaagaaacatgtatgactttgtaaaaccctaaaagtgatgttttcaagaaatttaggtttcttttttttattttataaaaaaaatgttgacatgcaatttaattctatttcaatttaggtgctgcaacctgtactggatgtttggggatagaaagatgaatgggacatgatttgtgtgctccaatgagctcagtccagtgtaagtgtaaaagttaaagtgccatattgtttattcagagtatatgttatagtttgtgaaccttatatcatttgttaaatgaaaggtttttataaatcaacagtaatattgccatcccatgtaaaaatcctttgatattgccaggaaacaactttaaatcaccagaaagctttaacatcaaataatacttttagaaggaggggaaaagccttccacctcgacatcgagcctatgaagtattccctaaaaaagaggaactaatctgagaaaagtttacacatttttaatactctaagttgtagataatgaaattgatttaaatcaaagttaactagaataggattcatgtgtcatgaattatattgtctattgtctcataagcaacaagtgacacttattatcttggctgacaaaatcagctaccatttaatgaaccaagttaagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtcaacagtagtttggtagcgtgcattagctttaactgtaatgtttgatgtttttgaatatgcatttatgtattgtttgtgtaatgacaaattaataaattagaaataaaataaaataatgtgtt

SEQ ID NO: 22429 - DNA, 826 bp, Homo sapiens
  ENST00000480589
agctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataataga

SEQ ID NO: 22430 - DNA, 2093 bp, Homo sapiens
  ENST00000466814
aatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttg

SEQ ID NO: 22431 - DNA, 715 bp, Homo sapiens
  ENST00000485421
ctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatcta

SEQ ID NO: 22432 - DNA, 312 bp, Homo sapiens
  ENST00000492828
gatctcacaggaatccttcaactgctttctaccaagcgttccatttgaacacgttaaaggaatcaaagagcctctgggataggggggaaatcacatggtatctagcatgggacaaagcagcaaaataaaccaaaaggacaatctctattttatatagaaaataaacatacttttctgcatcctgtgtactttaagtatatctatatttttgaagggttcatactgtgttgaatttttcttatgaaatagtcacttccccagtgtattttaatgcaaatgcatattctataaaataaactatattttaatttt

SEQ ID NO: 22433 - DNA, 930 bp, Homo sapiens
  ENST00000460316
aataagctattttaaattactgtatatttggttttaagtgaaacacaaatgtcttttacattcttttaagagttggaagggaggttaaattttttagaataataacatattctaattttttccagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttt

SEQ ID NO: 22434 - DNA, 1812 bp, Homo sapiens
  ENST00000372390
acgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 22435 - DNA, 2027 bp, Homo sapiens
  ENST00000372397
tttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 22436 - DNA, 2213 bp, Homo sapiens
  ENST00000315660
atatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 22437 - DNA, 2266 bp, Homo sapiens
  ENST00000372383
ctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 22438 - DNA, 2199 bp, Homo sapiens
  ENST00000372384
gtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 22439 - DNA, 1216 bp, Homo sapiens
  ENST00000372382
aattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaatgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttgg

SEQ ID NO: 22440 - DNA, 956 bp, Homo sapiens
  ENST00000506081
acatctattgaaagggtaacgacagacggagatcaactaaggtggcaggtaaggttcagaaaaggagaaggacaacaaatttggagaaataggagaagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccac

SEQ ID NO: 22441 - DNA, 569 bp, Homo sapiens
  ENST00000514426
atgcaatcgctacatctattgaaagggtaacgacagacggagatcaactaaggtggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccact

SEQ ID NO: 22442 - DNA, 576 bp, Homo sapiens
  ENST00000486554
gggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggatctggtgaagaatcatctgatgtatgctgtgagagaggaggtggagatcctgaaggagcagatccgagagc

SEQ ID NO: 22443 - DNA, 551 bp, Homo sapiens
  ENST00000503515
gagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcct

SEQ ID NO: 22444 - DNA, 802 bp, Homo sapiens
  ENST00000514897
gctgctctatttcaaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatgg

SEQ ID NO: 22445 - DNA, 546 bp, Homo sapiens
  ENST00000480691
agggtaacgacagacggagatcaactaaggtggcaggtaaggttcagaaaaggagaaggacaacaaatttggagaaataggagaaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggc

SEQ ID NO: 22446 - DNA, 581 bp, Homo sapiens
  ENST00000510887
agagagaaggaaggggaggactgaggagagacggcgaaggggcagagggaaaccgggacagagactgcctctgaggggttcagggaagagaggacacagcgagctggggaaaggagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagat

SEQ ID NO: 22447 - DNA, 567 bp, Homo sapiens
  ENST00000502650
aagggtgcgggcggggtggggcgaggggtggagggacaggatccagccgctcggggcccccgcccgccagccggagaagtggcggaggaccgttctccgccgtcccctctaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccata

SEQ ID NO: 22448 - DNA, 521 bp, Homo sapiens
  ENST00000506724
gcgtgcgtatttctggcggaggatgcgccatgagcgctgaaagagcctgaaccgaagcgtccggctcgccgagagagtgagagccgggccggctcccaggagcgcgggcgaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccat

SEQ ID NO: 22449 - DNA, 425 bp, Homo sapiens
  ENST00000505965
tctatttcaaaggccagacttgtgaatgaaggagccgatgcgggggtggggagtactgactgaaatcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctga

SEQ ID NO: 22450 - DNA, 503 bp, Homo sapiens
  ENST00000502961
aaaggccagacttgtgaatgaaggagccgatgcgggggtggggagtactgactgaaattattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgag

SEQ ID NO: 22451 - DNA, 474 bp, Homo sapiens
  ENST00000369517
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaa

SEQ ID NO: 22452 - DNA, 537 bp, Homo sapiens
  ENST00000256592
gggtcaccacagcatctgctcaccaatgcaaagtaagcatgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaaatattatgtttcacattatcttctg

SEQ ID NO: 22453 - DNA, 12187 bp, Homo sapiens
  ENST00000371497
gtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactgaaattttcgtgtatttttccccttgtaagatgttcaaatgctaacttcattttctcctttcctctatgtggcactttctcaaaatatctatgaaatacttttagacaaagattgagctggagaaagagatacaaatttccatccccccagacagagagacatatttccattgtaggaaggcattaaacattttgaaacttgtgaatcatctttagaatttctactggggaattttacttcttcatccaaagtaaaagccacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaaaaaaaaactaaccactccattcaactctctcagaaaataaatttcaatgtgttcaatgaattgtcttgaacctgaaacctgcatttagatatcagtcccctgccaatagctaatattaacagaatttgaacaatcatacaattatgtctcaaatgtgaagactttgtacagtaatattttcactttctaaatgacccatataacattcaggaattatagatgtgtatgtatattttttaagtacagaaagttcagccagtcttcagagaagtaaaagtgatgtctattgtgcattgaagtaaatattacaaacattccagtttcgcaatacaatacttgagctttcgaacacctcagacactagaatgtgtaatgcgagtcaaaaaagctgacatacaaaacaattcccatttggctcagggttcctaaatgtcacaatatcttgggtaaaatatactttttgatttcctgatgatgtccttctaatcccttctgactttgattcctaacagccaggcactgttgacatgaatcattaacttccaaacccctttaaaatcaagaagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatgaaaaaaaaaaaagaacttttctgctaggaagattataccaccctgtggccaaacagattcatcacagataggcatctatgcccatttctctgggatctggaaaattcttcccttggctgaccccaatttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctcaaaaaaaaaaaaaagaatggattttcagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattga

SEQ ID NO: 22454 - DNA, 3803 bp, Homo sapiens
  ENST00000603338
atttatttttctagaacacacccgacatgtaggctctattgcaatacatctgaaaacacaaaatctgtttgctccaaaattggtgatagcctctgacttaagatgatggtggccaggcgaggtggttcaagcctgtgattccagcactttgggaggccgaggcaggcagatcagatcatgaggtcaggagttcaagaccagcctggccaacatggtgaaacctcaggaggctgaggcaggagaattccttgaactgggacccaggaggcagaggttgcagtgagctgagatcacgccactgcactccagctggggatacagagcaagactccatctcaaaaaaagaaaaaaaagaaagaaaagatgatggctgctgcgttgctccattatacaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgaga

SEQ ID NO: 22455 - DNA, 980 bp, Homo sapiens
  ENST00000605656
agaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttgggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgttt

SEQ ID NO: 22456 - DNA, 670 bp, Homo sapiens
  ENST00000626626
cggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaac

SEQ ID NO: 22457 - DNA, 3093 bp, Homo sapiens
  ENST00000329613
atgatggctgctgcgttgctccattatacaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaa

SEQ ID NO: 22458 - DNA, 37027 bp, Homo sapiens
  ENST00000604411
taaaaatgtaaaagatcagctgggtgtggtggctcacacctgtaatcccagcactttgggaggctgaggtgggtggatcacgagatcaggaattcaagaccagcgtggccaacatggtgaaaccctgtctctactaaaaatacaaaaattagctgagcatgatggtgcacactgtaatcccagctactcagcaggctgtggcaggagaatcacttgaacccaggaggtagaggttgcagtgagccgagatcgcgccagtgcactccatcctgggcaacagaacaagactccaactcgaaaaaaaaatcaataaaaatgtaaaagatcattcttagcttggaggctataaaaaaggatgcagcatgtcagatttggcccattagctgcagtttcctgacctctatctacctcaattggttctttacttacattacatggaaagtgcaaacttggatggcttcaatgtctggcttcttttatttatttatttatttatttatttatttatttatttattttttgagacggggtctcgctgtggcccgggctggagtgcagtggcacgatctctgctcactgcaagctccacctcctgggttcacaccattctcctgcctcagcctcccgaatagctggaactacaggtgcacgccaccacgcttggctaattttttatatttttagtagagacggggtttcactgtgttagttagccaggatggtctcgatctcctgacctcatgatccgcccatctcggcctcccaaagtgctgggattacaggtgtgagccaccgtgcccggctggctggcttctttttacccttcacatctggctttaaatactaccttttcacagatttcttctctaatcactctttctaaagtaaatatgctgtttttcattattagtcattgcatcctatttctttccctttaattttcttatcacaatgtataattatatgtttttttttttttttggttattgcctgtctccctcaatagatcataagttccatttgataaggtacaatgtctgttggtttattagccagtgcctaacactaccatttaatatgtattcaatgaatatttgttaaatgtattgattgaatttaaagtgactactcagcctacttctgccccttggagcttggattgtttcttcaaaggtattgatccttttgactattttaattatgaattcactaaagacatctggaaggcttattgtgtcaagcagtgccaaatccatggcttgatgaacctagatccatccccttcccctttccatatcacagatgacaacttgatggttggcctatgacttgtaaaagttgtcatatttgaattctgaaatttctctaattttcttgggaagcagaaaggaaaaattagtagttggcctcaaagggacagttgaatttcacatataatgagcaaagtagtgtgaggaagagaggagggccttttcttttgaggtcataactaaaagttaggtgagcaaatgccataagcatgaaaatagcaaaccaagcttcttggtttctatccaaaggctttgttgggaaaagtatcaaagtgtgttcatttgttatgtaatatataaggtagagaacccaatttgaaggaggtggaataactttccaaaatacttatggctaaattctcagttgatcttggaataagattcaagaatccaaatgcacccttctttgttatcttgctagaaaacatgctgggcatggtggctcatgcctgtaatcccaacacgttgagaggccgaggtgggcagatcacgagatcaggagttggagaccagcctgatcaacatggtgaagccccgtctctactaaaaatacaaaaattagccagacatagtggcacgcacctataatccgtgctactcaggaggtaggcaggagaattgctggaacccgggaggtggagtttgcagtgagccaagatcacaccactgcaatccagcctgggtgacagagcgagactctgtctcaaaaaaaaaagaaaagaaaaaagaaaagaaagaaaaaagggaagggaaggaaaggggggaggggagggaagggaagggaagggaaggtaagggaagggaagggaagggaagggaaaagggaaaacaatgtgcttttacccacagctgataagcttttctaattgtctacctttgggttaaactttatcattgagtgtttttatcccattatgaaagaattaaggtttgaaggactgaggtaagggtggatatttactcttaattgagtagcttaaccaagtcaagccacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgagtgttttggtgtaactgggtttctttatgtacaaagctacagaattccccttgaagacactggccttgacatccctgaaatagcaaaatagacttttttgtttactccacgtgtagtatatgacagttagtgcattgtagatagggccatctattgaaatctacatgtgattatactctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgacacacaatttacccatggaaatttacccattggcttttgctgcaaaagtaccccttgaacctaaaataaaagttggaagaaaaaaacttaacatagcaaattcttagacattgttctgacttgtttgcaagacctatgctttcttcctaagctggtgctggatagttcttttgacttttttcattattgatcttctctctccctagcattgccaccaagggaaactatttcatgtaagacattcttttccatccagccatctggttggccctaatttctctgagcacatctttcccacctgtattgtgaaccatagagcaggcctaagggaaggttataaagaaggtaaggttggtctgtattgtctcagtctcttttaatatctattcccttctgtatggtactccttcttctcagagactcctgttctctagcttcttcataatcggctttcaaaataggatctgctgtcagcgatttatccctttagtgctaggatggtaaataaattttatcttgcatgccaactctaaattattagtagcagccacctgaaatgctacgtgaaggattctggggatgcatccagttgaattagttatgagaagaaaaattggctactataggaaagagaatcaacaattcaatggattaaacaaaaagagtgttaattatttcttacatgacagtatcaatgtaaaaagttcaaatcagagagggaattctgtttcttagtcattcagggacttgatttccttccaagtcattgtactttcatctcatagggaatcactcccatctgtatactgaaactgggtagccattacatctgagttgcagctggtgggagaaagtatggaaaggagagcataccctatgtcttaggacccaggcatggaaatggcatacatcacttctactcacattttattgatcataacaatcatttggctgcacagaactgcaaaagaagctgaaaaatgtaccctagctgggcagccacacatcaagcaagaatgggagaatgtattttggtgggcaacgagcatttttgtcccttactaggcttaacaggaatcaatgctatgattaattaatgaaattttccacgagttggaaaaaaactgtggcatccacccatattatggtattagctgatcttgccttaagtgtgaaatggaagtcttgttttctttcctagagggtcctgaagtttaaatataattccaaaaaatttgacaggcattttccactatgagaaaggtacttttgttaggtacaaaaataaacttgtccctgctttatcacttaatgtagaatcaaagattcgtctccagataacagaatttcagacatcagctaccaaggagggaaaatataggcttgggaaagaaggccttcttgtatgaaatcacaccacacaggcactagacagctctacttatataaagtttagctctataaaaatgagattggggtgtttcagagattttattaggaaatgtacagagaaaacagttgatggggcaaaagctataaacactaaggtgagaaggaatcagaatataggcaagagttatagaagcatctaaatggcatttgtatctgtttaatcagcctatcaggtaaatctgcccacttttctccctaccagtgaacatctgttttgaacctctaggatatgggacctcttgcttgataccagtctttctgtgcctacctattctaaagcctgatgtcatcttctgtgccttcccttataggcttacttccttcaacgctgaccattcctccagcatttcttattctaaagaggaacaggtaagaaacttcgttggagggaaaattaagcaaggattggcattagagagggagctgtgcacagtccctgtctcaacaaaaatagcttaagatgagacaagtactttacttagcataatcttgctactgaaggggctattctaaatgtccccccgcccaacaccattatgtaaacattctctaatattcgctacttaatttagattatccacccttccttctggccattgcattccttatctagcaatgcaggaaaagggcaagaaatcaaagggaaggaataaagggacttctgtttccagactgtattttaaagggaagtcatggttggttagcgattttctttagcttttgctttgcgtttgcagaatagctaatattattgttttacctatgggaactggtatccaatctagtgcccaatggggctgttgttactagagctattttctgtgaacctcatagcagactctcttctgctgaaaatgagatttactattcattctgggttctctcaaaagccagcctgccatctacaattagcggtcacatccatttggctatagttcaggtaagtccaattcttcatgtcctgcttctcagctctctgctgctcagagccaaaaaccttatcttagaaccccaaaatacatgtctagttgctgtatcaaagaccaggtagcagcctttacagaaagtcccttttctcagaatctagttgagccaatactatgcagtgtccactatattcttcttggttcattctctttcttttggaggcaacagcttactatggtgaggacaactggaatccatctctacctattcaccactttttaagtagtaaaattggtagctcaaaagtaactttattccctgctaagtcttgctctttccaattattattcaaacatgagaggtgacagtgagaagattggtttggcattataggatggtaccatgcaaggtactctaacaaccggccttctgtctcatggtctatctccctgcagattcaggttgcatcagctgtcctcctatgtccacaatccaaatgctatgggatactatggcagacaagttttccagttcttcaggaagtagcaactgtgagtattctagctcacaatgggaggagcacaacgactggactccagccatgagcaaatacaagtaaaggtttaactgagactgtctgctccccagttctccaacccctgcctaccccaagcccctttttgtcttgatttatagtagaaaagtaatagtcggtcgggcgcgggggctcacacctgtaatcccaccactttggaaggacgaggcaggtggatcacccgaggtcaggaattctagaccagcctggccaacatggtgaaaccccatctctactaaaaatacaagaaaaaaattagctgggtgtggtggcaggctcctgtattcccagctactcagggggccaaggcaggagaatcatttgaacccaggaggcagaggttgcagtgagctgagattgcgccatcacactccagcctgggcaacaagggcgagacgtcatttcaaaaaaaaagaaaaagaaaagtaatagtcacaaaatggatataaaaagagaggtaacaatgggaaactacaggggggcaaattaatacttttatagtttcagcagacctgtagtaacagaagaaaaactgattttcacttggttcagactatctccctgggctagaaagtatagggccaaggtagaggaatcggaggtagatgaattatcttcctgtgtcttcctttaagtagttcacattgctcccatttaggtaccagttaatagtcataattactataatccctctctttggatattctctaagactttatttcctcgtgagcataaagacataaaatagtacactggaggttagctatgattaggaagagccattctaactgtaaattactcataatccaagctctttcctgatgagcatgtatccgttataaaagaggctatgataatatacagtgagaaaagaatttgtttagaaattaagtgaatttggatctagggtcacctcagctattttgcgctgcgacattgatcaagttattttctctgggtttcagatgcctcatctttattttgtgcatttagatacacaattctaattggcccaatgggaattacacagctaacaccatcatgcagcaaaacaaaataaaatacagtggaactgaagtgagggagtaaaaccaccacactatgcagatgagactatctgcctagtaacaagacatttcttggactctggtacttcagccaaatgtcctctgggagtggagaggcggggagacaatatagtccactgccagaaagaacccacatctgttccaccactctcattgtcattgcgtttcctgggatactttcagaataattcattagtaacaacaacaacaacaacaaaaaaaaaaaacagcaaggaaaaggctacaaggggaagggtttttctaggtctttgggatatatctaatcatttcttcacggaatattataaagtagggtccactcaaagctcatccctcacaagccactcaacctttgacattcttcttctatttaatgtgagtcagaattcctaagattttttgaaatcctgcctgcaaagtctgcttatgaatttttttccttaccacggagttcccataaagtgacaggttctgcctaagtagttagctacctgcaaggctgctcgaatccaactttctttcccactctactttgcattctgctctccctttgctctcctctccttaggccctcaagtgatgccagcttttgttctagcactctagaaaggagttactattttgatccagagtacacagagaagagaaactggagtgggtaaaaggaagctcgtcactgagaatgctggtactgggagcaagactgtggcaaacccaggaaatactaacaataagaacccctcaaaagttcacctttaccaagccaatggaaacaatatagctgagtggggtttgaattttgagaactaatgactcctcagctaccatgtaattgccttggtgctccatttgctataattcatgggaaaggtactaaggtccttcaactggttttccttgctacctccacctttttcagaagttggacctatgattagcacacttcctgcctatccattcacagtgaatagaatggctggctaaattttaaaccccatttaaattattccacttcgaaatttgaatgatagatgcttgcctaagtctactggcctcagtaacattaccttttctcatgaccaagggtaaaagagtaaattgataggaggcacaagtttttgtggatgtgggttgggctggcaccaaatccaactacaagcatacagtgaccacttcatacacaccacataaaaaatacaaaaactgaaaaatactatcaaatgctttgacattttctaaatatttctgctgcccctataaaattgccttgtctgacctttcctcactaaccaggagatacggtgtttttcatttcctctcccttcaaattttacaagagaatcaaggaatttgaggaccaaagcaccacaaacacaagagtaagcacagcaaatatgacaaggggactgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacataggtaagagttcttcaggcatcggttttaaaggtccatgtactgggacgggtgcggcggctcacacctgtaatcctagcaccttgggaggccaaggctggtggatcacctgaggtcaggagttcaagactagcctggccaacatggtgaaacccagtctctactaaaatacaaaagttagccgggcatgatggcgggtgcctgtaatgccagctgttctggaggctgggacgggagaatcacttgaacctgggagacagtggctgcagtgagccgagatcacaccactgcactccagcctgggtggctgagcaagacactgtctaaaaaaaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagag

SEQ ID NO: 22459 - DNA, 1649 bp, Homo sapiens
  ENST00000545802
cggcaaccgcacagctgcctcggactctgacttaattccctccgcgtgctctgaatcgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccgggagccgccgctctcagtctctctaggcgcagctcccttcgccgcttccggagcccctggcagggcccagaagccatggcccactataagactgagcaggacgactggctgatcatctacttgaagtatttactctttgtcttcaacttcttcttctgggtgagtgaattctgcacacacatcctcttccccgagcactgaatgagtcaagccaccttttgtttttttgtgtcaccactttgaggttgatatcttccaaatcaaagatcaacgatcaaccatgggtgaattcttcccactttaaagcaaatatgtacatttgctactgagaaagaagaaaagaattgggtctgcaggttggcatggagtttgtaccacatggcatctgaatagaggcacaaacataacaataggctttgtgttctagccctgctgtacaaagggtccggttctttcttccccactaacttgttgcaccagcgccttttggaaaatgtgactgcctgaaataataacttgttttccactgaaatccattcacctttcatggttaacattctccaggcccagggcagagaaacagaagtcctggaggctccaactactgctgcctgtgatgaaaataatctctatggcaactctcctcaggagcctgcctgggtgaggtcttccagaggagtgtagtctgtccacttgaagcaatcatctgggtaattgggagcagaataccatcagttcccaaaaatagacactggaatatatatatttgttattacagtctcactaaatttgagaaggtagaagagtgacaagagtgcaggctttgcaggcagctgtacccatgctctgctgactactaatggtggagccttgggcaacttacctaacttcaaggaatctgcttccccagctgcaattcaatgataatttctagcctgttggggttgcattcagtaaatgcagtattttgaatatattagatgtcaaatgcctgaaaataccaccaaatcaacccatgataaggcatagctgggcttcctgctaccatggtgagggagaagacacttgacagagtcttagaagcatctcagaaaggcaaatgcagaagtgggggacatgtctgagttttcagggtctttcttgcaggggcttgcttaagattgggaaagaccatgatgtgagagtttaggatgggtagacatggcaaggcaagagttttgaagagtcttggagaataaaccagtcattagatgctatctgttaaaaagttgtgcgatctgctatttgtttaaatgttgtttgcaaagttcctgaaaggaataataaaataatttgtcactttta

SEQ ID NO: 22460 - DNA, 1058 bp, Homo sapiens
  ENST00000546076
agtctctctaggcgcagctcccttcgccgcttccggagcccctggcagggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcaggg

SEQ ID NO: 22461 - DNA, 988 bp, Homo sapiens
  ENST00000535215
agactgtcccgagcttcccccgggcgggcagagggaagccggctggggatgaggagtggaggaggcaggaatgcctgggacactcgcggggcatgtgagcaggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctg

SEQ ID NO: 22462 - DNA, 5505 bp, Homo sapiens
  ENST00000261177
agtggaggaggcaggaatgcctgggacactcgcggggcatgtgagcaggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggcagccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcaaccctgcaaagtcggagctgctgagaaggggcagctctgaatagaggggcatctgcctgaacctcacttttcctggggccctctccttgaccccgtagccaccaccacactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatggctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagaggcccaggatacggcaggttctgcctgggagtgtacaatggttggagtccagagccaacgatgtggtccccagcggggtgtgcccctcctgctgacgagggtacagatccatacccaggtcaattcctcccgggcccctgtttggaggctgctacagccttgagttccttggagagagaggacacgcctgtggaatgtcaccttcagtcccgtgcaggcaaaaggcccctgcacaccagggccctaggaaagcagcatcaggtgctgggatcccacccagctggcacgggcacgttcttgccctgcacactccatgctgcccttccctgagctcgcaggggcagacaccaagagaagggcgcgtccccgagtcccctgggtgacctgtgtcaggacagcaggcaagaatgaaacgtggccttggctgacgggttggaatatttgtgaccgttcttgtctttctccctcctgcttccccggcaccctagccccatctccaggagcccctcaggcagagtaagtggggagtgtgtccagggatttttttgtgtttaccaaggtcctgctgtgcacttagaatctgtcaccataaatacttatctcgcagttaccccagcaagagggtgttatttcccccattttataaaaggaaattaaggctgggcaaagttaagacttgcttgtcagtggtcatggctgttgtcttgccacccccagctggggagaaggaagaaaactgggccgggaacccctcccctcagtgtcccccagttctccatctccataaggagccatcaggctgtcattaaggaacagagtgtcactcagggggcactgtcacaaagcagcacccatggcacatgggccgggggtgcagaagcctggcttatttcaggctgacagctggaccctctgggtgcaggggctcaggcagtggccaagagcccaaagggctaaggcccgtgacgaccacccagcccgtcaccccaggtacaaacactgaccccaaagcaagagcagggactgtccctcagccctcagggccttcatgcagggtgcagaatctcatgtccacatggaggtcacccctcaggtcacacccactcccagagcaaccctgggcagggaggggcaccctggggttgtgttgaccacctccccttcaggtgaggcccttttctgccttctttctagccccctgcatggggcacctgctattgctggggctctggggtggaccctgtgtgatttctgtcagggagcttgtgctgtgcatggccagaggtgtttacatccagaagggcccagcacggccctgtggggtgtggggggaatatggtagatcattgtgatgtgcctcggggccctcttgccttggagccagctttgtttcagaatctgctacttgggccctcttcagggttttgaggctggagaagtgagttgggacagtcactgtcatcaccacccaccctgtcacccacctggaaaacattcttgatatactggccatgctgggccgggctcacatccactgagggtatagtgaccaagcgtctaaaccagtcgttctcaaacttcggtgagtatcagaatcacctggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaacctgctacatgttggctgcccccttcccctatttcagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 22463 - DNA, 16183 bp, Homo sapiens
  ENST00000429989
ccgcaccgggcggcgcagggaagcggcgccccttcctcggcagacggcaggcgccgcgcctccggccccgcccctccgcgcccctccgcgccccgcccccgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaagtgaaaagtgaaagtatgtcttctgttacgcagaggtaactactattaggaatccttcctgaaaatgtccatgcatctactcaggtcatcacacccatggaatcattttacatactattttatgagtgttacttaatatactgatccacagtgcgttttcacggtcacgccatcagttgtaggagtgtgccaagaacagatgggccttgcctttgtaccagaggagtccatttacagttgcaggtaatagaaaacccaattcagactggcctaaacaatgaggggaggttttggctcttgaaactggaaagtcccaaggtggggtgagtttcaggtttgggttgatccaagtggctcagtgacgtcaacaggatcttgtttccatttctctgccttccacagcctccccttcatctatggtggagggaaggagtctaccacagacaaaccccgagcctccccctgatgggtggtgtggtggtgaagccagcaagggaagggatccccggacacacccctcctcatgctttatcccactgaaaccatgcggctgtgaaatgcagcatcctccaggagggggatgaaggccggggatgctgtcagctattgccattgcacttctgtggatgggtgttacagttttttgcagggttttgcacttacaaggacatatatatatatatataaactacagtgttattggaattgcttcttacagtttgtaagaaaaaaacatgtttttagaggagttctcctgggaggtgggatcacatttttttttttttttttttttgagacggagtctcgctctgtggcccaggcgggagtgcagtggcgcaatctcggctcactgcaagctccgcctcccgggttcacgccattctcctgcctcagcctcccgagtagctgggactacaggcgcccgccactacgcccggctaattttttttgtatttttagtagagacggggtttcaccgtgttagccaggatgggggatcacattttaataagtaggtactcagggctggggtgtacctgttgctgcctgaccactgctggtgtgtgtgggtataaggtgacaaaacctcctacccctgtgaggttgtttcaaggattaaatgagttgagatgggtaagcatctaacaaagatccagattatttagtatgcatcccctgaattattgctaacataattttaatgattggggaattttatctgtggctgccagtccctacgagagagctgcctgggtcacatgtcagatagctcaagctttgaatcactgaaacgaaacggtccacttccctgtccctttaggaacaaggcttcgaggtctgtggcaagcctcagcaggcatttggagttcaaggtctgttctctttctgtgccatagaggtggggagacaaggtagggtgttgcttcttgcctggagcgcagatgctaccagaaaccaacacaaccaaagttgcccgggagcccccagaagcagcagagtggccatcaactgccaaggggccagggtaggccacagaggcctggggcccaggagggatggtctgtggggagaaaggggattattgtgaacatcaacgctggggataatgtgccctgaagacagcagcatatcacgtttggacggttggtggaccccatctggtcccactcataaggagaacagaggccctggggtgtgctgggacttgcctgaggcctcagaccgggactgggtgctcctccgcacctcctatgagggagggtgtccgtgtctgtgaggacagctcagcagggctgggaacctgggggcagtgctgggggacatgtgtgagactagcgtgtgtgggccttgctcggcttgccctggtgccctgagaaaaacctggtatttgaaaatacacatggactgctggaaggtcaggaaatccagggttttgttctgaggcagtggaagtgttaccgtgagcctgtgttggcctctctcctcactccacctgcagccaattcagccacactgcctttgcatggaacccagggttgcaggccgcgtgtgtagatgctgatttaggcccaagcactcagctgtcagcaggaaggaccatagtgttttcttctagttttagatatgcactcgttctgtgttttaaagtcacagctgtgagccaatatgggaagaagtgaagtggcctctaggagggactgagcaccctgtccttggaggtatgcaagcccaggctacacccttcctgtctgggatgatatggctgggggtgggctttgtgctgcgtggaccatggcaagcctttccatctctgagaggtagtggtccttcccgtgccttctgttaaagataattttttaaaaaaaggcataactcatatatattacatgtacacatgtcaaagattttatttaactcagtaattgagagtgctgctaagattaacagccagttcaaaagagaaatcacaatgaaccataaatctgtatggagtaaaggaaagttgaaactggctggggtttttttttttttttttttttttgaggagaaaggtcaattgaatcttattcgtataatatgcacatccatagacaagaattattttgcattaactctacaacttagttgtaaaaatagctcaaaggcagtgaaagactagaatcagataattggaagggtgcaccctaagcaatgcatagttctattttctttctttttttttttgagacagagtttccctcttgtcacacaggctggagcgcagtggtgcaatcttggctcattgcaacctctgcctcccgggttcaagtgattctcctgactcagcctcctgagtagctgggattacaggcgcatgccaccacaactggctaatttttgtatttttagtagatacagggtttcactgtgttggccaggttggtctcatactcctgacctcaggtgatccacccgcctcggcctcccaaaatgttgggattacaggcgtcagccaccacgcccggccccaatgcatagttttttactgaagacaaccagaatctctgttgcttattccaaatttccttccaccacttgtccatccagcagagccacttttaaaataggacacaggcagaaatttaaaggagtcaatatctcatggtgaaaagtgaatcctgagggttagagcatccaccaggtgccctaggtaagggccagccactctgggaggcagcccggggcactcactgtcctctcagtagtaaatgaaatcactcaggccatgtctgctacccagagagcctgagtgtcctcaaatgcttgttctgcctctccatccactcctgcagacacctcagtggctgcatcccaaaccgctgaactttgcttctctttctccaacccccaattccacccacatccaaaactgctctgccccctattcccatctcagctgagggtactatcatccaccctgtggccacatccaggaatgtgtgtatcacctgggctctgaggatgacatcagctcttctaagtcaacagaatgtcgggtctgttctaaaagtctcatctgacaaggagatctttaaggctttactcccttaaaggctttactcccatcatgatgggataaccatcatgatggatttcagtgtcattctgtctttttcttcggaatgattcctgggactcgccttgtttgcaacatgtgcattgaaatatcttttcaacataactttgttcttaattgtgtttacttcctttctctgtgaatctcagtgattcctggaagctgtggttggtgggggatggggtgggaggactttggtagtataaaagagtacctgcaatgaatgttctaagaaactggagtgttggggtcctccagcccttggctggtaaactctccactccttcctctttgcaacacaattctcataactggcaaaggtgtgcatgtaaaatttgtgactgtagtctgaggttttttttccctgtacaattccgccttcccccctgtaagcctgtaccaggagaggtctcagctgccttggaggcggtgagacacgtgggtgctcactgtggccctcaagggtgaggctggcactggggcatctggggccagaagtcctcctttagtcccaagtctctgccactcaagtgcatcagtgagaggtcctcatagaaaatctactgtgggcacaaagctgccaggctgatgggggtggggagcaaacgaacacccttttccccttttacaccagaggaaagagacttagactgaggaacttgcctgctgccagacagctgggaggtggtagaaccgggcttacagcccagggtttccactctaggaactcttctcccttcctctgatgacactaactcgcaggccatgatcaatgagcaacgatgtaggcaggcactgacgaggcacagcaggaaggcagctcagtgcccatgacggccaggaactgggtaccatttcctcagcaaaatgggatagtaactcccacactgcagctacgcacttgggcagtggttcacaaggccagcagccacaacatcaccccagaccagcagcagctgcagcattacccccagcacttgttaaaagatgcaaattcaggccaggtgtggtggctcgtgcctgtaatcccagtactttgggaagccaaggcgggtgggtcacctgaggtcaggagttcgagaccagcctggccaatgtggtgaaaccctgtctctactaaaaatacaaaaaatgacccgggcatggttgtgggcgcctgtaatcccagctacccaggagaccgaggcaggagaatcacttgaacccgggaggcagaggttgcagtcagccgagattgtgccattacactccagcctgggcaacaagagcgaaactctgtttcaataaataaataaaaatgcaaattgtatgccccttccttcaggcctatgggaccaaaaactgggatggggcccaataaaatgttttaaccagcccttcggtggttacagaaggatagagccagaatagactaaccactgtaacaaacattacctatacttgggaggctttgaaaaatgtttatttagccgggtgcggtggctcacgcctgtaatcccaacactttgggaggctgaggcgggcggatcacgaggtcaggagattgagaccagcctggctaacacagtgaaaccccgtctctactaaaaatacaaaaaattagccaggtgtggtggcaggtgcctgtagtcccagctactctggaggctgaggcagtagaatttcttgaacccaggaggcggggcttgcagtaagtcgagatcacgccactgcactccagcctgggtgacagagtgagactccatctcaaaaaaaaaaaaaaaggaaagaaaaatgtttatttttttgctcatgccacagtctctggtagttgctgggaactagggtgggggattctctgctccacacagtctttcatggacccaggttcctttcctgttgtgggtccagcctcctgtagctgttggaggcatctctagtcagctggtggttggggaagaggtgaggatcagggagggaagatggagagtactctgcttgttctcacattctgctggccagaactcacaagccacctgaaatgatgcaaaggtctagctgtgtgtgtaggagaaagaagagaggccagatattggaagacagcagtggtctgtgccccaggccccatggtttagggaagtgaaccttggcactggatttcctggctttctaaatctccctttatagggaacttagggcccagtctgtggtgggtggatttgcctggttcacagcctctggtcagccttctttctgctccacagggcggcctggagatggtgggctccttgtcacactggttggggatgtgggctccatggggccagagatgtgtgtgctctgtgttcagattaagggacagacggcacatgaattccttcagtgccctccagatttggtcactggggaggggtaggctgagcagtagctcttgggtctgtagtagtgtgaccctggaaggactgtccagctgaaaacaagagcctggggcgtggggaggggaggggttactcagggttccatgagacctgggtttaagtcctggatccatcattagcagctatgtgaacttatgcctcactttcctcaaatatgaacttgagataatgaaattaccttcctcataatactgttctaagaattgaatgaggaaaggtttacaattcggccctggttgttccactggggagggaacagagattgggggcacagggctcccctggcctgggggagtctggctcactcaagttctcagtcatttgcaaggcaaggaccctgcttctccttgctctgggtccgagtagtctcaagcccagtgggcagggcctgtggtgtggatggactcgtctgcagtgagtcaggcagcaggcagagctggcaggctgtgtggtctctagtgggtaccaggggacctgggagggccttgtgggaggttgtccacggtgtgagccagtttgccatctggggtcctggagttccctcccgccctttgagttaaaaagagtcagtcctgggctgagacttaattgcgctagtgctgagtgaccttgtgtcaggggaaatcggatggggcaaagtgttttttaattagcaggactcactgacctttccttcactgtcagcaacttctcacagggaggcagagcaaggggggctggagccccgcatctctctaatggagcctatgtccaacaaggaggtggatggctggattcagggccctgggaggacttcatgtgggaagcagacctcaggaagggcccttagtgatggtgtgggccagggttctcacctccttagtctcctgtcctgtccatctccgcagatcctaggcaaaagaagcggagaaacactcaagccactggggtggttagggcacactggtggcaactgtttaaaaccttaactaaaacaaggttaagcaaaaggagtttacaggctctcatagatgggaaggatgtgggagggtcacagactgagaggaaccagggctgtggctgctggaaggagcctcaccaccgccagtgtgtttcctccccgtcgtcggcatctctgcttctctctgcacgccagcagctctctcttagggcacgcagacctttcctctgcaggggaacacgagtgccggcagccccgagttagtgactatcatagaaactcagtgtatttctctcttgtttatcattccgagtcctgagtcacaggcttgtccagcactcaagactttttcttttctctattttttgaaacggattctcgctctgtcccccaggctggagtgcagtggcccgattttgggtgcaagcgattctcctgcctcaacctcccgagtagctgggactacaggtgtgcgccaccacatccagctaatttttgtatttttagtagagacggagtttcactatgttggccaggctggtttcaaactcctgacctcccgccggcctcagcctcccaaagtgctgggattacaggcatgagccaccacgcctggccaagattttttcttttaaacctggagtatggagatgctcactaggcagacagaatcagccaccacagcccactccctcagccagtattactttgactaagttagtgaggaaccaggccccagattaagaagcagaactcacactgtcatctgctgtgtgcctggctggctcatgcataccttgtctatctaatgtggaccaaagccctgtggcacaccctgctggttacccccagtggttaccctggcacagaggaggaaagggagtcgtgggagggagaaggacttccctgggaggtctctgggctggcaagttgggtgacacaggtccggttggctgcaagcctgggctctgctgttgtaatcataaatgtgtgtgtgtgtacagttgtttacaatgtcagcatgggtgtccttgtttgttagagatacatgccactgctcccatcatgaggaaaatcccaagccctccccatgatttttgccagtttctggggactcatgctcctggcagcccatgtgtccccaactcctgtgtcctttagggacctctgttgagccctgcctctattctggcagaattagagaaaattctttaaaaaaacaataaagtttaaattcatttaaaaaaataataaaaaatctcacagcatgagttttgatgagatttggggcaaggtgggccacaaccttgggttgtatggccacctccccctcttcttcccctgttgtctctgcagctcagaaaccccaatttcctggcctgtgttatgtggaggagctgagctcaccccctacagcttcatctccaaacctagcaaggatcctgcccagatcaggagatcctccttttaacagaagttatttacactccttagaaagcagtgggggtggaacgattctttttcctgatgcagagatgtaaaactgggacattgctacacataatattttaaacctgtcttccctcttaccaacgaacacatcactagcaccatctatgccaatacatttctcaacatcaatttcagtggctgtattacattttatcctacggatgtgctctcatttataatctaaaccacttttattgaacacatcagttattctgaaattttcagtgttatgatggatgttgcagtaattattcttatatatgcacagaacccccagaggacatgactactgaaggctgtgctggcaggatcacaggtaaggatctagcaaattgtcccagcttcattgactgagctttcatccttgttgcactactttgagctgccattttgatcatataataatgatttagtagagctcttttttggttcaacctacctgttcttgtatcagaactgaaatgtttgattttataaatttgaatagtggcacaatatagagttcactattcctcaatattttcaaggctgtttcttatctgttcattcttttggttaacttgggaattattttatcaagtctctctacttcccaatttcctttcacctttggctcgaaatgatattcaatgtatacattaacttgagttacattttgctgcataatgcttgagttacattttgagtattacgtgttactcataatacatattgagttacattttgctgcataatacattatccccaagtttaacaccttaaagcagcacatatatatctcatacccttctgagggtcaggaatctagaagcagcttagctgggtgactgtggctctgggtctctcatgaggctgcagtgaaactgttggccagggctggaggatcccttccaacctcactccatgactgttggtgggaggcttcagttctccacctggttctcacaatataatttcccccagagtgagttatcagagagagtgtgcaaccagtaatctgttagaatatgtcacgtctgtcatatttgattggtcactcagaccaaccctaatagatgcgagagtgactatgcaagggtgtgagttccaggaggaaagcatcattggaaccatcttggagactggctaatacacagataaatggcacatctgacaatatggcatctttctgagtgtcagtgtggtgtgttcctatatgaacttaatgctattaaacttaattaaattgtaggtatgctctcagtgaagatttttacttttacattacaggtttccacactgttaaattcattccaagtatttcatacatgctgttcctattatgaaaggatcttttttttcacatggcattttctaagtagttgttgcattcatataggagatgctattgattttgacacccataatttttcagtggagacaaggcagaaactactccagactctcacctgctgttgctgatccttacatggtggctgtgccaggctcagccgcgctgagatgacagggctgtctggccatcattggtcatatggacttcagatttgaaaggattttatgtagaagcagagtgcctgataggactctccgggacccccatttctgccctgcttggctcccactggcaaggctggctcagttcctgtcaccttctcctggactttggccagagtccactggctgtttcccctgcctcctgctctcccagtgccctctccacaccagtgccagagctgcttctaagagatgcctcaaagcccgcttccagcttaggaaccccagggaacatggatggtttctccattgccacttcctagccttcctggcataggaaggtctggtttgcctgcaggtccctctctgggggggtccctgctccatagatgctgaggctccagaagtctgttcttttatatcacatttgaaaacctttgaaatgcattatagttgagtcatatgaattatgtaagtatatcctactcattgtataaaacaacacagaattgt

SEQ ID NO: 22464 - DNA, 808 bp, Homo sapiens
  ENST00000481124
cgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatg

SEQ ID NO: 22465 - DNA, 855 bp, Homo sapiens
  ENST00000372157
acttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagtgctgccctgctttctctgtctctttcagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctg

SEQ ID NO: 22466 - DNA, 959 bp, Homo sapiens
  ENST00000469149
cggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctgtaagcacctccccagcgggcccccgatagagcatgcacctccctgtgctgcctggagctgagtctagcaggggcatcaggccttctctgtgggttgtctgcctgcagcttggcagacagcagggaggccgtggaacaagccactccacctctggtctgttccactttgccggcttgtggttgcctggtgggccagccctttcccattgggattgggcaggcaagtccagctgtacccgaggccacccaccccccacgtgcccggccctcctctttcggccccagatctttccaatcctgcccaatagccataccagctgcaatcctccttaggcgctgcataccgtaaggcacagcttcttccccccggctcatgactcaccatctgacgctattcctatccccttcctccccgggaccttttccccttcctccctgggaccttttcc

SEQ ID NO: 22467 - DNA, 5476 bp, Homo sapiens
  ENST00000372164
ggccgagccgggccgcgccgccgctgccgccgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaa

SEQ ID NO: 22468 - DNA, 1095 bp, Homo sapiens
  ENST00000372158
ctgccgccgccgcgcgcgggacttggggtggagtcgaaagcagggagccctgtgagttgcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 22469 - DNA, 1037 bp, Homo sapiens
  ENST00000341863
gccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctcca

SEQ ID NO: 22470 - DNA, 1380 bp, Homo sapiens
  ENST00000372156
gggcaggctggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgagacgaactcttgcaatgttgccttggctggtctcgaactcatcttctgggttcaagctgtccgtctgcctcggactcccaaagtgctaggattacagcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 22471 - DNA, 2588 bp, Homo sapiens
  ENST00000265450
attacctctgtaaagagcctgtctacaaatacagtcaccttctgaagtcctgggggttaggacttcagtgtatggattttgaggacacaatttagctcctaacacctctaaaattaggggctaatactccatcatgttgccatggaggaggctgataggtgtgagggggctggggccgattgccctgtgtggggtgggcagggctggggtgtgtgctgggatggttactgacaccccaccggggttagcagtggagggagctggttggctggcgactgttgcctgctggctctgtctcctggagctgagcttactggtgggatgcccgctccgagaagcacccttcttctcttcttaggagactctggacccccttctccaggtttctctccctttagaggcacattttcctccaagccttcaagccccttctctttctccagatgtggatggtggggaagggtatcttgagaaagttgggctttaaatctctggagacctgaaaggaaacagccagggagcctttggtcagacaggtggtgcgatggcacagtgcccagcgaggggcagaggctgagaggagctgacgagcatctcctggagagtcctccttgcctgcctcctggatccctcgttcccaccctgctttgccctgctccttaccagagctcactaggggatcaggtggggacatcgtgtgtgccaaaggctcagacccctgtggtgttttcctgcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctg

SEQ ID NO: 22472 - DNA, 2436 bp, Homo sapiens
  ENST00000616406
cgcagattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatatt

SEQ ID NO: 22473 - DNA, 1698 bp, Homo sapiens
  ENST00000373290
cggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacgggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgtttttttttttttttttt

SEQ ID NO: 22474 - DNA, 616 bp, Homo sapiens
  ENST00000478112
gagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcagtgagtggaccacaccacccctcagccgggactccccaggagagctggggcgcctgcccctgtgcccttgggcagctcagtttcttttgtccctgcctcaaaccacctcctttagagagctccttagatcagcccatctgaccacactggcccaagaatgcccaggccacctcccctcctgcatgtaaaagctgatttgaatactgttcttactta

SEQ ID NO: 22475 - DNA, 605 bp, Homo sapiens
  ENST00000475069
cttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccaggtgggcaggccgtgggttcagagaaagtgtgacttggtgattgcagaagggcagagaaggtgcagaggggaagagcgaagaggcttttttcatagaagtc

SEQ ID NO: 22476 - DNA, 575 bp, Homo sapiens
  ENST00000452130
ctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagataacaggagtttctgactaatcaaagctggtatttccccgcatgtcttattcttgcccttcccccaaccagtttgttaatcaaacaataaaaacatgttttttttttttttt

SEQ ID NO: 22477 - DNA, 709 bp, Homo sapiens
  ENST00000490083
ctgccatgttcctcccggcagggattgtcccagccctagccgagggggaccgagtgctgcagtgatgaggagaacagcccatgagggaggtcaggagacctgaattccagtcctggcaagaccccacccagcctgctctgtgacctcactccctccccaagtctcgagctcctcatctgtaaaacaagaggctggatggtggaggagtgtggagaggggctctggagggcaaagggaagattccagcgtgggcccatccctgggcggtagaaagagcactgggcctggaaccaggacagccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgt

SEQ ID NO: 22478 - DNA, 693 bp, Homo sapiens
  ENST00000486093
attgtcccagccctagccgagggggaccgagtgctgcagtgatgaggagaacagcccatgagggagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccaca

SEQ ID NO: 22479 - DNA, 834 bp, Homo sapiens
  ENST00000459981
gaggctggatggtggaggagtgtggagaggggctctggagggcaaagggaagattccagcgtgggcccatccctgggcggtagaaagagcactgggcctggaaccaggacagccaggtctcagctcaggcatggcggcatcagagctgtgtgtccccaagcacggccccagcctctcagggcctgggctgtctggtctgcaaagggagtggagtgaattactcctgctgggacatagcacaggcactcaggcatcagatgaacactggaggcacggggaggatgtgtggaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatgg

SEQ ID NO: 22480 - DNA, 674 bp, Homo sapiens
  ENST00000470508
cagaatctagggtcaccttctcatgctgcatatgggaaactgaggatcacagcggttgagggactagcctggaccttgtgtacatggcagagtcggggctgtggctcctgccagccgaggtcctctgctgggctgacccagctccttcccatgcagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggcc

SEQ ID NO: 22481 - DNA, 726 bp, Homo sapiens
  ENST00000533786
tttcttatctgcaagtcagaggagggtgagttccccaggctttcaacagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacagtgagt

SEQ ID NO: 22482 - DNA, 549 bp, Homo sapiens
  ENST00000533202
aggcgaggggcagcccgcagaggagacgcgcttctcggcagcaacggcgtctggagccgggaggggcggagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaa

SEQ ID NO: 22483 - DNA, 840 bp, Homo sapiens
  ENST00000533080
ccccggtcccggccccgagccccgagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaa

SEQ ID NO: 22484 - DNA, 3316 bp, Homo sapiens
  ENST00000520358
cggccccgagccccgagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaaca

SEQ ID NO: 22485 - DNA, 871 bp, Homo sapiens
  ENST00000520999
cgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccagctgggccgataaaagaaatatacacaagcctcgctgacgggagagtctgtcctgctgatgcccgaagaactgcccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacagtgagtgac

SEQ ID NO: 22486 - DNA, 565 bp, Homo sapiens
  ENST00000520837
agaaccaagaagcatttgtctgctgaggcccaagactgggtagaggtggtgagcatcgtcccccgtccgccaccacagcatgcaacaggctcctgctatgctcctggggctgctccagtctgacagctacagaagagggtgagcatctcctggaccaccctcaagcttcaggtgagctgagcttctaacactaccatcaaagcaactggaaccccttgaatttgatttctggagacgcgagcataatccttttgcagacatctcaacgctggctctccagctgggccgataaaagaaatatacacaagcctcgctgacgggagagtctgtcctgctgatgcccgaagaactgcccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctcttt

SEQ ID NO: 22487 - DNA, 1184 bp, Homo sapiens
  ENST00000518429
gtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaa

SEQ ID NO: 22488 - DNA, 709 bp, Homo sapiens
  ENST00000519051
ttaaaagcaattcaaggtgcggctgggactcactggctctcgccgcaggtgaattcctgcctggctcacctagtgcttgatgcctctgaccctggggctggctcaggggagtggtgggtcagaagtgcctaacctccctttctgcctgtttctcctcccaactcctccactggcccgagcagctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctggg

SEQ ID NO: 22489 - DNA, 981 bp, Homo sapiens
  ENST00000520245
actcaggattctcgcagcccgtacaacctacccagaaggaaatttacccagagtgggctcaaacgggtttcatcagcgatctccttccagggtggctgagtagggttgttcaggttgcacactgtacgaggggcctctctaagggtaccatttgcatggaaggtatatatttgtttattcttttcatattttgatctcaatcctgttgactccaaggaggaatcactggtgtgtttgttatgaaaaatgtctgatagcagtggagtgccttaatcttacaaaatgagtatactgcgtcactggtgtgacagatggacggatgcattggccagtggccgccccatcccctgcctgccctctgggctcacaaggctgttcctctccctgcagttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaa

SEQ ID NO: 22490 - DNA, 827 bp, Homo sapiens
  ENST00000517621
ctttcccatggtcacacagtggtgacaggtggagcccgcccacacccagtcttctgatgccactcctttgcagaggctgtatgtccttctctgtccccgcccctgtgtcctcctcctgcccaccagaaccttctctgggatctccccctagtttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcaggttctcagcctgggcccaaagaatatgcaggctcctataaaggaaggaaagttctcccactttgaaaatacgtgtcattcaaaggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagac

SEQ ID NO: 22491 - DNA, 700 bp, Homo sapiens
  ENST00000521990
tggtcacacagtggtgacaggtggagcccgcccacacccagtcttctgatgccactcctttgcagaggctgtatgtccttctctgtccccgcccctgtgtcctcctcctgcccaccagaaccttctctgggatctccccctagtttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccc

SEQ ID NO: 22492 - DNA, 817 bp, Homo sapiens
  ENST00000520278
atatttatgggaaatttcccaatattccaatcactgtagttgcaacattagacatggcctgcacgctgtcagttctctgtcccaccttaggggccgggtggcaaagagggtctttggtgcaatgctgccaagtcgctgtttctgggtctcctgccctgcaccccctccccactgtcctgtctcagcagccgtgtgatagggtgagagctctggggacacctgccatgaaccctagtccacatgctggactctgactccaggactctcaaccctggccatagcttgacctctcatccctccctcccagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttag

SEQ ID NO: 22493 - DNA, 4229 bp, Homo sapiens
  ENST00000340160
agtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaaaaacaaaaaacccatgctgggcaggactgaggcaaattgcacagctttatggctctaatccaggggcatcccaggcttctggggcccacagaagtcagagggaggacccaagagaaagggctggtcatgaagggaaatctggctaaggtgggttcaagggcagacacaagactgcccctcagcagctttctacaaatgtgccaaggaaccctcaatcagccctgattcagctcgccagccagccactggccaccctcttaggctggaaagggaagacaggcagtttctgctcctgttggcattcgctcaggctggtagctatttgcaagactgcctgaggccattccttggaggcaaggcaaagaaagctcagcccaaatcaggcttgagcctccctccagagcacagggagaaacagggtttagctggcttggtccagatacaacccacagcaggttctggtggtggctggggttgtgggggaggggtgggcagggatacctctttgtttcttttcaccccgaaatacaacagcccataacagagacttcctcggaccccactaacagggcaaggaacaagaagactacaccgctcatcacaaaccctgcctgtatcgaaagccactttcctgctctgaagctactgcctcttagagaaagggaatagctctttatgggctgggggtgagggcccctccccagggtccctgttaatttctggccttggtgctcaggcctgtccacagcctcccttgtctatgtctctatccatgcttaaggggcccggacaggatttcccaaaccagccgaggccccagcacccgccgtctccccagaagccccctcctccttcccccatgggtcatatgttgaaagtctattttaaaaactatgttccttgccgtagattgcagagctaatttatcacgtttctctcctgtgagaccccccttttatatgatatatccagaggaagttttgtaatataaaacaggacgcccacactgatggttttgcactggtttttgtgaatgtttcttacaaaaagaaaaaggaacaaagaataaatagtgaccgtg

SEQ ID NO: 22494 - DNA, 3177 bp, Homo sapiens
  ENST00000369516
ggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaa

SEQ ID NO: 22495 - DNA, 793 bp, Homo sapiens
  ENST00000369515
ggagcctgccgctccccgcgctcgtagcgcgggcctggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatga

SEQ ID NO: 22496 - DNA, 464 bp, Homo sapiens
  ENST00000491992
atgaagggtcacaggagatggctacactcccttctggaacattcagtgggactgtgctgtccgtggagtgctcagagctacatgcagttaatcacagaaggcttacagaggagatgggccaggccagagttattctgattttttagacactgtgatatgaagaagtagctgtgaattcctgggccaggtgttttcagtttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaa

SEQ ID NO: 22497 - DNA, 671 bp, Homo sapiens
  ENST00000433172
ggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataa

SEQ ID NO: 22498 - DNA, 3242 bp, Homo sapiens
  ENST00000508798
tgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatatattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 22499 - DNA, 3365 bp, Homo sapiens
  ENST00000305798
gcgaacgggcgggcgagcaagcgagcggcgtctccaccagcatctgccgcggccgcctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 22500 - DNA, 1191 bp, Homo sapiens
  ENST00000505184
gttgccgcggctggtctgtgccatgctcagcgtgtatcttcttgcaccatctcgggctttgtgtaggatgcagatgccgtggtatatggtcctgtaattgcacgtaaataacgtttcctgcacgctctcctcttcagctggaaagcgctcccttttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcag

SEQ ID NO: 22501 - DNA, 4062 bp, Homo sapiens
  ENST00000511753
ctggtcttacagataagttcacaagcagctggttctctcttgtggatacatgggaccacagtggctgtagctagtttcctaagactccatctgccttatctgccagatccttcctttgccacacacacacacacagtgtctctctctctctccctccctctctcatacacacacaaccaaatgcttcattcttcacctagtcagaaacctggggagcccccaggagagctctgtccctgattgccacctgccaacctgccagtcttcttggcttgaggcatctcagtgctccagtgctcagctcaccttgccagctttcctgtagcctgattgggtcctggtcatactcatctgttgccactatttcatcagtttcggcctccatgccccaaaatgtgggatccttttttttttttttttagatggagtttcactcttgttgcccaggctggagtgcaatggtgtgatctcggctcactgcaacctctgcctcctggattcaagcgattctcctgcctcagcctcccgggtagctgggattacaggagcctaccaccgtgcctggctaattttttcatttttagtagagatggggtttcaccatgttggccaggctggtctcaaactcccgacctcaggtgatccacccgcctcagcctcccaaagtgctgggattacaggcgtgagccaccatacctggctgggatcctctgaattgtattttttttttttaagtaaagatggggtttcaccatgttggccaggctggtcttgaactccggacctcaagtgatccaccttgctcagcctcccagaatgctgggattacaggcatgagccactgcacctgctcagtccccttaattgtgatttactttaatatagtttcatttatagtggtggcccctttaatatagtttatcatttcttacagttgaagagtccagtgttaactgaacaggcagaaaactacacatttctctaaatcagcaccttaatttataaagtctcatgttggaaatgaagagaattgtgttgtttcttggcttttaagacttggaaaatatcttaaatggcctctctccatttaggacaaacaataaaaacttgcctggaataatcttcgaacagaaggtatgagataagtagtaagtaaacgtccacaggactccaaatagctctaaagatctgattcccctaggagacttgctgagggaaaatctaggaactaagatactgcaaaatggaaatagaccttcttggttgaccgaggctctagggtgaagcctgtgagtcagtgtctgcacctttggaaatagaggaaattagctcaacagggcttggggcatgtaggtatctgccaaatattttatatgaattgaatttggactcaatttttggtatgtataatatgtaacatgaagagaaaatttaccaggggaactggaaaatgcacttaacttttatggaggtgagaacaaaaactgaattaaaatctttccctgacttggtgtttcctgtgtatgctcatgcatgctagctataattttgtcatttctgtactgtgataattcataattcatatttacatgcttaaggtggggcctaatacagggcagggcgttatttacactgtagggtaggcattgagcagaagtggtgtgatattttttctgttcatttttctagattggggaaagtttaaattgaaattattggcatcactgatgataattaagaactgtttaaattccatttctggcgaattcctgaaggatatataatcaggaactctagggaaacctgaagggctgagctggagggtctagaattggggccttaacctgggagtccaaaaactttgccaaacacttatttccaccttccactcctcctcccgtgcccaccctcacagagcagtacttggcaccctagacaaatactgccagatctacagacatctaatgtctgcagatacccactccctgcctagcctccctaatcacataagactgggacatcttcgaaggcaaggataccccttgttcttactcatccttgtttctgcaaagcccacctacctcagggcctgactcattgtgggtcattcagtagatgtttgctgaatgaataaacattgtttgtcttttgttcttttaatgagtaactgctgtttcctttgcacccctccccaatacatttttctcttggctggcagctccttgtctgcttgctgaagatagaaccgcagaccacctgagcaccccctgcctcctcagctgctcactgttcttctgcatgtggccttcaggacctctgcccagcagttgtggcccatgtcaccctctctgctgttgtcaccagaaatttacccgcactgtaccctctggtccttcacagctcatttctcataatctattttaacaacaaagtttgagaaggttaagaatacaggatggtaggaggtggaaaaaacagtgggcgtgagcagtaagtcgatatgactaagctgagactcttctgagtcttctagatggaaggggaatttctccagagttacgggcagttaccacgttgcctcatggtcttgagcccctcttttaaaacccctgttgtctacattaagcggaagtctccccttggctgcattttgatgtcacttaaaatgttgctggggcccatgcttcctagaggaaggcaagcacagctagcattcccaggaaagccctcaactcaggggtttcattttgtttttatgatgggaaataactttcatttcgcggtcactgcccaccccactacttcctctttgaccccttcatctaagatgaacacatctgttattttaccctgtatagcaggtgcaaaagagaattaaaatggtgtctgaatccataaaaggaatatattgcatagagaatcaaggccacagtaacaagtgacaggcgatcttaaaatattggaataatctatctttcaagttacagaagcttactagagataggggcaggtcattgttacaagcatctggcagtacattaatcatgagaaattaattaggccttaatgtgggtctaatgagaaatccttattatccatgtttgcttatgggctttgttggttaattatcaaatggaacactagagaccctaaaatgtgattataaaatgatttttaaaagtcctttcttggagtgtaatattctattaatgaatcagcagaaactgaagattatctgctttggagatgtgtaacaatccaatgtaattacaaacctgtttagagaggaaccatttagctatatatgatcaaaatagcccttataactgttctctgtgtatgtgtcttttatcttagttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaatt

SEQ ID NO: 22502 - DNA, 605 bp, Homo sapiens
  ENST00000515440
aagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttgacaaacaataaaaacttgcctggaataatcttcgaacagaaggtatgagataagtattttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgca

SEQ ID NO: 22503 - DNA, 539 bp, Homo sapiens
  ENST00000509168
attgctaataataacaccagtgggggaaacttgaagaaagaggtatttgtcaccaaatgtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgc

SEQ ID NO: 22504 - DNA, 574 bp, Homo sapiens
  ENST00000515287
tttgtgtaggatgcagatgccgtggtatatggtcctgtaattgcacgtaaataacgtttcctgcacgctctcctcttcagctggaaagcgctccctgtgcgtaatggactgtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcg

SEQ ID NO: 22505 - DNA, 710 bp, Homo sapiens
  ENST00000511651
gcaccatctcgggctttgtgtaggatgcagatgccgtggtatatggtcctgtaattgcacgtaaataacgtttcctgcacgctctcctcttcagctggaaagcgctccctgaggacttaaatgcattggacagtggacaaagaccatttaaatggattacaaaaagcagacttcaccaggcagagcggcctctaacttcttcagtaatgttgccatttaccatgtgtctgttggggatcaggtccgtcgctaggcacccttcgtgcttttaggacattgccgtggaaggaaggggagaaaccttgatagggcccttggatgaagcactgcagcttatgctaagaagatcaaggccctgttagactggaaacattcattgtaagacctagtgccataagtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatc

SEQ ID NO: 22506 - DNA, 581 bp, Homo sapiens
  ENST00000511800
accatctcgggctttgtgtaggatgcagatgccgtggtatatggtcctgtaattgcacgtaaataacgtttcctgcacgctctcctcttcagctggaaagcgctcccttttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttgaagagtccagtgttaactgaacaggcagaaaactacacatttctctaaatcagcaccttaatttataaagtctcatgttggaaatgaagagaattgtgttgtttcttggcttttaagacttggaaaatatcttaaatggcctctctccatttaggacaaacaataaaaacttgcctggaataatcttcgaacagaagttttctgtgttcctgggaattattttcttcctggagctcactgccggagttctagcatttgttttcaaagactgg

SEQ ID NO: 22507 - DNA, 540 bp, Homo sapiens
  ENST00000507167
tccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttgtaagtattccactctctactctcagattgagagccaaaactttaccttccatcaggaggtcaccctatctacaggcaagacagtgagctgtaccaaaggcactggccaaagtagggcccaggtcattattttcttttgagagagctctctagccctgattcccagttgtgcctccttaataagtacaacacc

SEQ ID NO: 22508 - DNA, 2206 bp, Homo sapiens
  ENST00000373020
agttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctag

SEQ ID NO: 22509 - DNA, 1025 bp, Homo sapiens
  ENST00000496771
gtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccatta

SEQ ID NO: 22510 - DNA, 820 bp, Homo sapiens
  ENST00000494424
agctcttcagtagtttctgaacatctagacggtaggatgtagaatagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattg

SEQ ID NO: 22511 - DNA, 3796 bp, Homo sapiens
  ENST00000612152
ggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatatttagagtttttaaaaaagttttccctcagccagccatggtggctcacatctgtaatcccagcactttgagaggctgaggcgggcggatcacctgaggtcaggagttctagaccagcctggccaacatggtaaaacaccgtctctaataaaaatgcaaaaattagctgggtgtggtggcaagcacctgtaatcccagctacttgggagactgaggcaggagaatcacttgaatccaggagtcagaggttgcagtgagccgagatcacaccactgcactccagcctgggcgataagagtgaacctgcatctcagaaaaaaaaaaaaagttttccctcattattaaaaaggaaaaattatagaaaattaaaatatagaatgtagaaagaggaaaaacaccacacatcactcgtcaggtggattggtttgtttatttttaagatgggtttattttggatagccagttagaaaacgcccttatagctgatgtgtgcttgtgcatactgaattgtatacttaattctgaaagtaatgaggaaacatttcacctaatgataactggtacaaaggaaagttcacgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggt

SEQ ID NO: 22512 - DNA, 900 bp, Homo sapiens
  ENST00000614008
ggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaagacatt

SEQ ID NO: 22513 - DNA, 4161 bp, Homo sapiens
  ENST00000581692
atgtgagaacattgttggggagggtgtaccatatcccagccccccagacttcggacagggggataggcaaggaaccctcaggaagtccggaggaatggaacgggtcacctccctggacagtggttttggccccagctgttccccaggggcatcagagtcgaggggcagggccagagcctctttcctgatctcagtctcaccggcctcttctctccagggggaattaaatggacaaaggggcctggttccatccaacttcctggagggccctgggcctgaggcaggcggcctggacagggaacccaggacaccccaggctgagagtcaggtcagtgaggagctgggctcccagcttggcagggcagtctaccctactggtggggtggtagggccagggcagtgttgcggcaggggtgcagctggggtggtcatgcaggtaagcactgtgtccagcgtgcagccgctaattgaccaccagaggggagccccaccaagcagctgccccccagtatgtgcccctctctgcagagggatgatagctgtgaccctgaccctcaggccatctcgccagctgccaacacctggtggctgacgcaggtgagggggccctgtggaaaaggacccctctgcctcacacctgtggccaatcaaagtccctgtttcaggacactcccaccctgggggtggtctccatacctcccaggtgcctttggaagccagttgcccagccaggcccagcttcctgggttctcgttccttgagcttgcctctccttggggtgagtggaatacaactaagcctccactctcagagggcagggagagagggtgaagaggccaagccccagccagaaaactcagggcttccatgtgtgaacacaaaggccttggagagtagggcccacccctgcgcagggccacctggtggccgggcggagaaggtgcgggtctgtcggtaacccatctcctctctttgttccctgtcctcagagaacgaggaggagaagagtccagtgctagatggagatagatatatgtagagagagcaacatgtaagtgggggactgcccccctgtgtgaccgtccacccccacttgaccataatcagacagtgctcctttgtctcaaatactggagctgacccagctttcccactgtagtccagggaatggcgaaggagagcttgccatgagccagatttgcatgaagagtcatccctccccctccctgctccccttgccttgcctttacccagggcagtgccagctgtcataggattacatgtcatcttagtgtgtgatgtcccatattagctgatgcttcctattctataacacatgtggtttatagaacatgacgtgacatccatattaggactcatcagtggtattatgatactgtgtggctatggtattataatatcataattattactggtgccagggtgacactgtaatgccaccagtaataataggcttcccacccttgtcctctgcattgtgacctgttagggtgatcagatgcatgatttacctccaactctcagttttctctacttgggggataaaaggggaggtttggccaggtgtggtggctcatgcctttaatactagctacttgggaggctgaggtgggagtcacttgagcccaggaggtcgaggctgcagtgagcggtgatcacgccactgcactccagcctgggtgacagagcaagactctgtctcaaaaataaaaaaataaaagggaagtttgagtagttcaaatccataaataaccccaaaccattattctctggggctcagaaacaccctccttttgtttccctaacaacctctccctcctggatgttgtggaaggagccctaagagggagtgggaagggcctggggctcgccagccggctattggctctggctggttgggggtagatgctttggcctctgtgggcagccctgccacatcactgcaggcctggggcgggggtggggcctcggttgtgcacccactttccttgcctctggcctgggctctatagttggttctggctgggagcctgccaggctccgggcagcaagtgggagtttgaggaagggaagacatgcaggctggcaagagctgacagagctgtgcaggtaccagaggtgaaggtgggaacataggtgtagggggctttctggtggcttctctgttctcccagctccctggccttagatcactaaggagcgccgtctgggcgggcttgaggcaaagggagtggagtcaggaggagattcagtaaggaaaaagatgctagagcctccagagcctgtggtgggggctgagtgatgcccccagctgtgagtccctctgggtccttggcctcccggcagtcctcttaggggcccttaagggagagtcccaatcttcctccccatggagtgggtactggctccacaccctgaaggcctgggggggccacatctgctgggtttggggagacgctctttctgtctatgaggggctgtagaagctaccttcctgggcagtgacagctgcttctaagcagtccttgtccttgcgctccatgtttttggagggaggtgacatgtgagaagttgggggcacccatcctgaggggcaggttccaagaactcttgggccctgtcagccctgcaccctggagggagaagggaaggggcctgcccagggtcacaggtgagcgatccagaaccgagactgcatcccctgggactcccagcttagtgctccctcggcatcaccctccccattcaccacctgtgctgtgtgtttctgacagtggtgggaggtgaggccctggttctcagcgtcagccatggttctgtgacatgggaggctgcaggccccttaggctgtggaaaaaatgggtcagggggtcaggagggaatcaggccctgaccttgctccttctgtctcacatttcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaatct

SEQ ID NO: 22514 - DNA, 1553 bp, Homo sapiens
  ENST00000581675
cgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 22515 - DNA, 7483 bp, Homo sapiens
  ENST00000268893
ctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 22516 - DNA, 1504 bp, Homo sapiens
  ENST00000578511
ccctgctgggagacagcaactgctccagcggggttatttgtccccagatattctccttgagggctcaggtatgacctgctgctgtccctcacccacctcccaccagcccccttccaactccacctgaccctgagcaattgttgtgtctggggtgctcccacttacccagactctagcagagccttggagcctgccttgaaccctgctgcgtagtggtcagactgtacgtgggctggccgcgtggagtgggcgtctgttgcagaggggaatacagccatgcagccaggaattttgggtcctggaggttgggtggggctcttgtcagggatgggagatgaatgcccttacgaaacaagctcagtaacctagcacggccctgagaggaaactccagagtcccagtcctgtctctcccacctcccctgcctcgctttctctctgcttttctggatcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgt

SEQ ID NO: 22517 - DNA, 5947 bp, Homo sapiens
  ENST00000343736
agcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggag

SEQ ID NO: 22518 - DNA, 746 bp, Homo sapiens
  ENST00000577871
tgcttttctggatcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggacactcccaccctgggggtggtctccatacctcccaggtgcctttggaagccagttgcccagccaggcccagcttcctgggttctcgttccttgagcttgcctctccttgggagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggct

SEQ ID NO: 22519 - DNA, 809 bp, Homo sapiens
  ENST00000580669
gagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcag

SEQ ID NO: 22520 - DNA, 887 bp, Homo sapiens
  ENST00000582679
ggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaaggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagcccacacaactgggcctcctcccaagccccgccgctccaagaaag

SEQ ID NO: 22521 - DNA, 471 bp, Homo sapiens
  ENST00000578486
gagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgactgattcgccatcagggctcagaattccaaacaccagctgggtcttccctcctccctcctttcctccactggaggtagcacagaatcatggtggagaacatggcttctagagcagatgacatgggtttggacctgactctgctgcttctagctgtgtaaccttg

SEQ ID NO: 22522 - DNA, 381 bp, Homo sapiens
  ENST00000585149
gtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaaggtatagccctgcccactgtaccctgggagtgggggtgggtcccttcttgctatgctcagaggtctaggctctctggcttggcacggagatgcccagcccctggcatttgggtaccatgaggcagatgggtta

SEQ ID NO: 22523 - DNA, 409 bp, Homo sapiens
  ENST00000583624
gggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggtggggcggcagtgagggaagctggcaggctgctggacaccagctttgccactcactcattccacaagcatttactgtgtgcccggcactgtgctaggcgtcggggagactgtggggaacaaagaccaggtccctgagcagtcagcaaattagcatccaggagtgagctgatttcagacactgatgagcacagtggtggagaagaacagggtgatgtgacaaagtgactgggatgg

SEQ ID NO: 22524 - DNA, 3076 bp, Homo sapiens
  ENST00000375173
gtcccccctggaaaagggaacaatcaaagaggaaaagaccacttaacaagggggttgggaggtagttggccagctttggaatagctggtgagagagagaaactttcattaccatctagttaccacctgttctctagatgggaaaaagaaaaaaaaagtcagtaaatactggaagcagacagttaccagaagtcacccccacaaaaaaataagctgggtggtgggggtggtggttagttgttgttgctagaagacagaagacttactatttggaaaccttccccgggttccacaggatctacgagattctagtcagcaaagggagcaatgcctgtccacgtgtgtgtgaatgtatgtgtttataatgatggcttttccttcctccccagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagca

SEQ ID NO: 22525 - DNA, 4320 bp, Homo sapiens
  ENST00000341170
cgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaa

SEQ ID NO: 22526 - DNA, 1503 bp, Homo sapiens
  ENST00000375172
aattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctact

SEQ ID NO: 22527 - DNA, 1612 bp, Homo sapiens
  ENST00000375165
gaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaaggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcaggtaggtcagcacaggctcagagcccaaactgaaatgaagcacattgtcagttcactattctagaaaaatgacacagggaagacaggccagtgctcattactgagcactgaataagcagggaaaataagtacattgtgccaccattttcccagctgtggagctgagagaaccctagcccaggagtcaggaggcctgggttgggatcctggcttcaccattgctagctggacaagcccattaacatggggatcatctcacctgccctgcctgcctgtctacctgccaagagctgtactactgggctaattcagggctcttaacctggaattggtacatagatttcagggattctgtgaatttggatggaaaaataattgtatctttgttttcaataacacctcactaaaatgaagcatttcctttagttatgaatgtaggcaacaaagtaccagttgtattaatgtacctgtgactttgtcttcagtaggattcacaatactttcatatcatgttctagttgcctcagatatctcaaaatagtatttatactcatcactgcttcaaaatgaaaatagttattaggcccaccactaagagttgatatataatgtgttaataaatggcacgtcttattatatattacagattttgaaaaaga

SEQ ID NO: 22528 - DNA, 584 bp, Homo sapiens
  ENST00000375163
gaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggtatgcttgcttttagaagattgtgctttaattcacagggacaaaacttaatagacaaataagaaagctaggcactgtgatcagcagcagtcatgagtcctctctaaagcagctgtggggtggctaacacttggct

SEQ ID NO: 22529 - DNA, 500 bp, Homo sapiens
  ENST00000484708
gtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaaggttacgagacagtacaatagaaggagtatgctcgtccccattctttcactgagtcaccatatgattttggaccagctagtgctctagacctcagtatcccttcttataaaataagaatgttacagctcatgcaatctgggactccaaatcttggacatattagctcacttgagagaccaccagcctggtcagcagatcactgtgtttttagtaaatctggaattgtaagattaacacttcataccacatgggggaataaagttgttgctctcacaggt

SEQ ID NO: 22530 - DNA, 491 bp, Homo sapiens
  ENST00000502782
gccgaatacagcccgcacacgtcgcagctttaaataagtagggccgtggggcccggcgctcccttccatccttggacggaatgtatcttctcttcctacgccttcacctccgaggggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatggcctcccagttcaggccaagaaacatgctacatcagccaagaatacactgttgacctggaaggcaaatacgacctcaaataaggagaaagaggaaatcctggaagctctggtc

SEQ ID NO: 22531 - DNA, 545 bp, Homo sapiens
  ENST00000506758
attgtctccttggccggacctgggctgcggaaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactaca

SEQ ID NO: 22532 - DNA, 1353 bp, Homo sapiens
  ENST00000505624
attgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatga

SEQ ID NO: 22533 - DNA, 3410 bp, Homo sapiens
  ENST00000508722
tgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggtcagtgggttggccagagcccaggctgggttgccttgtttggccccaggcttggttctcagggccagggaagcatgggcttctcagaagaacaagggctggaattgattctgttttaaccctgactttcctccagatccacctaagagcccttgatcaaaccttaaatgaccaggccagagaacactgactcaggtgggcgaatgtgctgtgtcattggctgtgcagacagcacttccccctccccctcttatctctgttggtgctgtaaaaaagaagcaaaatgtgagtctactccaaggaaaaaagatacagggacaaccgaacttaaatcttcagcaaaaacaaaaggcctttttaaatgaaaaatcatggtattttagggtaatgctgtcatttgtactttaaactagtctagctgattatatttccaaacctaaggttaaactaacaaaagggtgtttcacttggaggtaactaacttgacaaatgcccgggggaaaacaaaacaaaacataggaaggaatggtgagtctattatattagggtacttttatgtatcatgtacttgaagctgctaaattcaccttttctctctccgaaggagaatgctgcctgtggcttcaggtatctcccacagtgacaaacatcaaaatactggatatcctgtatcatagaaaaggtgcaatgcaatctaacagtatacatgaaaacagactctgaagaaaaggcattgcaaacaatctgacagtccacaattataaacatcacacagtggagagatgtcagagaatgctgctgtgaaggcagggagtccactgcttacagagaaagccagtctggtttttgtgttcaagactttctcaaagcagtggtcagatcagaatgaataaaacaataaatagcagtgtttcccaaaagcaccaaaagataagagttaaaatgtatggaatgctttttctacgttccctagaggatatatcgattcatttaatctgtacaatagctctatgaagtaggtaccattattattttatctcattttaaggatgagaaaactgacgcacagagttatagctaactcagctgacattgtatagctaagaaatagtaaagcagggatttgaactccacatctgaccctacagcctgtattcataacaactctgctctgtgtcttggctccaaagtcttctctgataacccctcagctctttgaaacacctcacagtatttggcctatgaaatattaagcacaggtggttcttttgtggctggtgggtgtggactcaatgtttttctctttctcttttctaagtgttactccttccattttagcacaaataatataaaatctaacacttttttagtgcttactatatgctgggtggtgttctaaccactttacatatattaaccattaatttatttaatatttacaacaactttttataacaaatactattcttattatccctgatttacatttacaagactgccttcaagactggagttcagtccagtgagactgagctaaggttatgactttatttttgctatgaaatctaataaaaattatactagccaacatttattgagaacttaccacgtgatgagcaccgtgccctgtgctttgcatataccatctcacttaatccttcccaaaccctaatcagtgggaattatatattccttctacgaatgaaggtgaaattacttgcacaagactcatagctaggaagtggcagagctgggactcaaactcacctctcatctaaatccacagtgaacactgtcattgggtgcttaccttgtcatgattttctttattccaggctcattctgtctgtgtttctttgttcactgaagtcagccccaaaactgcagaaatgagtgcgttactggccaaagcttatgccatgtctggagaggcccagcacaggggtaggtaaaagaggtagccttgaagttatttcccagtcacatgagggaagcacattggcaaacagcctatctaagattctaattagctatttattcctgtaatggaaaaattaggtgggtcacagtctcatacaaaatcaattacacattaatttaaacctgataatatacccccacattcgttggaatgtcagtaacaaataaatcatctgatttctacatcctctatttattttgaatctcagtgagattcaccttcttaactaatagatatcacacatactgtgaatgtggcctgtgcagtatcggttgataaggacatccagtgataaatgggtagagctttacctcctccactttcagtctccttgactcttttcctctggctgacaagagagaatgtttgttagcagaattttcttgacccatattcaatagttagatactgggggttgcagagaaagccaactgattaatttatgcttcaacaatagttctttgtctggcaaggtcatctttttgaaagtgggtggctttgggagagacacaaatgaaccaatgagggaggacaatgtatcattctgtgctggcttgatcagattaatggacactgatggattcagtggcctgtcaggaggaatttaggcttcatgaagaatataatttgatcattttaaaactgtctattttctttgcttataaaagtaacctttttgtgtatgttattttccagttagagagagggacagaattatagagaaagctttccatcctacttttttcaatgcttgtattccccatgtcattaaataaacattttttttcagtttgcaaaa

SEQ ID NO: 22534 - DNA, 348 bp, Homo sapiens
  ENST00000508377
aggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatggtaaaacaaaaaactcactaaaattttgtttccatttaaa

SEQ ID NO: 22535 - DNA, 1225 bp, Homo sapiens
  ENST00000514080
agctttcgcgaggcaccgctttggcgcccggaccgaggtgcgccagggtcaggaggccgacgcagcgggaggaagccgcgccgtcgggctcagggagctgggaggctggttccggggcgtggtttctccgccttgagccaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacag

SEQ ID NO: 22536 - DNA, 977 bp, Homo sapiens
  ENST00000502674
atgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcagatgctgttgagatatatttcataagaagtatcaatgcatatcgagcaacattgggctcagaggattttgaaacactgagcaccactgaagaattttgcaaatggcttgtccaaaatggagaaaaacaggacaagtag

SEQ ID NO: 22537 - DNA, 973 bp, Homo sapiens
  ENST00000610313
atgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcagatgctgttgagatatatttcataagaagtatcaatgcatatcgagcaacattgggctcagaggattttgaaacactgagcaccactgaagaattttgcaaatggcttgtccaaaatggagaaaaacaggtaaa

SEQ ID NO: 22538 - DNA, 1185 bp, Homo sapiens
  ENST00000638320
attgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggtaaa

SEQ ID NO: 22539 - DNA, 11795 bp, Homo sapiens
  ENST00000397906
gggggcgcgcgcgcggtttgggggcagtgaggggcgccgcggcggcgcgcagcacggcgggaacatggcgcgcggaaccggcgcgcgcgcctagctggcgggaccgttagctcgaggcggacgcggcccgggccccgtggggatggagcagtcgccgccgccggcgcccgagccgacccaagggccgacccccgcaaggagccgaaggcggcgggagccagagtcgccgccggcgtcggcgccgattcctctctttggtgctgacactattggccagagaagtcctgatggaccggtactgagcaaagctgaatttgttgagaaagttcgtcagagtaatcaggcctgtcatgatggagatttccacacagctattgttctgtataatgaagccctggctgttgaccctcagaactgcatcttatacagcaatagatctgcagcctacatgaaaatccagcagtatgacaaggcactggatgatgcaatcaaagctcgacttctcaatcccaagtggccaaaggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaa

SEQ ID NO: 22540 - DNA, 905 bp, Homo sapiens
  ENST00000431039
gacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccggctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggacca

SEQ ID NO: 22541 - DNA, 407 bp, Homo sapiens
  ENST00000480563
gggtcgagtcttgaggtgggctggaggggaaggagacacagggtgctcacgctgtccccccttcctcagctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggtta

SEQ ID NO: 22542 - DNA, 574 bp, Homo sapiens
  ENST00000469670
ccatccagtgagtcagatgccccaggccagcctgtgagctgctcccctgccaggccctgctctttctgctgggttaacctcgaggcgtaagtgagccctggaagccggggtggggctgggggtctccagctgccctgctgaggtgccctcctttgctttctgcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccga

SEQ ID NO: 22543 - DNA, 499 bp, Homo sapiens
  ENST00000442232
gagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacagggatgcaaccaggtttgcggaggcctgggattgggcctggacacatgttcttgctctgccaacttctcagccagtgaaggcaggtgacacttacctccaccaggtgatgcaggctgtggtgataaactagagtgtgaagagctcagagtgcagcctctggccttgccactcacaagctgtaggacactagggaggcagtttcacctctgtcagcctcagtctcgtcatctgtgaaatggggatggcttcttaccctgcagggttcctgtaatgtgggaataaaggagccaatgtataaataa

SEQ ID NO: 22544 - DNA, 724 bp, Homo sapiens
  ENST00000490475
gcgaaaagactggactctcctggggcttttcccttcgcagtgaatatgggaaagaattagggggtgggagggaggcagcatgacttgcagtcgtcgctgccctgcatctgcccccagcccccagccaacatcttgatgttccacgtatcggctttacaaatatgatgaaatggcagccccggaagaaggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaa

SEQ ID NO: 22545 - DNA, 594 bp, Homo sapiens
  ENST00000468807
acggcgggaacatggcgcgcggaaccggcgcgcgcgcctagctggcgggaccgttagctcgaggcggacgcggcccgggccccgtggggatggagcagtcgccgccgccggcgcccgagccgacccaagggccgacccccgcaaggagccgaaggcggcgggagccagagtcgccgccggcgtcggcgccgattcctctctttggtgctgacactattggccagagaagtcctgatggaccggtactgagcaaagctgaatttgttgagaaagttcgtcagagtaatcaggcctgtcatgatggagatttccacacagctattgttctgtataatgaagccctggctgttgaccctcagaactgcatcttatacagcaatagatctgcagcctacatgaaaatccagcagtatgacaaggcactggatgatgcaatcaaagctcgacttctcaatcccaagtggccaaaggtagaaatttttacctatgaagatttattttcatagaatcttttgtcctggcttcttactttaatgtaatattttgttgatttagtgtacttactaatattttaataatctgtacttcagcaaa

SEQ ID NO: 22546 - DNA, 11274 bp, Homo sapiens
  ENST00000612946
aggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaa

SEQ ID NO: 22547 - DNA, 735 bp, Homo sapiens
  ENST00000402414
tgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggaggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactctt

SEQ ID NO: 22548 - DNA, 822 bp, Homo sapiens
  ENST00000333610
ataaggcacaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaag

SEQ ID NO: 22549 - DNA, 710 bp, Homo sapiens
  ENST00000495698
tttaagatcacttaaaaatttgagaatgaaattgattcacattgtgacatatccatagcaaactcgggctttgggctggctttccctctttgcttagtatttatctgttctgtcttctttgccctgctggtgtgtgcttagaaaaatgaacaatcattttaatgttatattcagcagaacaaattggcagtgaacacactgtaaagttagtatgcttttcaggttgacattgcagtggtataaccctacaaaagtagataacagggttaaacaaaaattgattttagctctttatttgtacgttttttcttcagcttggattttcagtgttgatgctgcatgttataggctgtgaagtttgacaatacccaaaagagaatgaaagtggaaatgagaggaatttggtaacacggtgtttttaatgtgaactttttgtttaaagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaa

SEQ ID NO: 22550 - DNA, 779 bp, Homo sapiens
  ENST00000431392
ctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacggtgcggagagatttccgggaaccaagccctctgcgcgatcctcgggcgcgggccgccgcctctcaccccgccgtctctccttccacgttcctcattcgcacccagagacttaggacagataggaattttccactcgtgattttagctggcgggaaatccgcgacctgggaagggaaggggtcacggctgcgtagggccacagtaccgcgactcccatctcagtgtcacggcgcaggctcttggtggtgtttttcacttgtgaaaaacgtttaaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgg

SEQ ID NO: 22551 - DNA, 549 bp, Homo sapiens
  ENST00000414814
aaaagggattcctccagatggccagaggggtttcttctgatggggtggacaagggcacatggctatgttctagctttgcagtgaatgttaaaggtgctcacagtgaaactgggtgactaataggatatagcagctggtcactcaacaaccctcacaggacagcattgcctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgag

SEQ ID NO: 22552 - DNA, 603 bp, Homo sapiens
  ENST00000452597
aattaggtgttccctcctccagggcacatggctatgttctagctttgcagtgaatgttaaaggtgctcacagtgaaactgggtgactaataggatatagcagctggtcactcaacaaccctcacaggacagcattgcctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgccc

SEQ ID NO: 22553 - DNA, 591 bp, Homo sapiens
  ENST00000419081
aacactaactaactggggctcagtgctctcttccgccttcagtgccctgctcatcaagggtctgggtgaggccccaggtcataaggaagccctcgctcgactgccccggggcccatcgcagcccccaaccagccccgagcggtctgatggtgcccagggaatggtttccaaggcaatagcaaacggggcggggcttggaacggaggacaaggctcgagcctaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgt

SEQ ID NO: 22554 - DNA, 540 bp, Homo sapiens
  ENST00000438596
agtgctctcttccgccttcagtgccctgctcatcaagggtctgggtttcccggtcctctggcgaggatcctccaaggcgtctcacatgaaccggctcagaaacgccaaaatctacgtggagagagctgtcaagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtct

SEQ ID NO: 22555 - DNA, 555 bp, Homo sapiens
  ENST00000459758
agtgctctcttccgccttcagtgccctgctcatcaagggtctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcataggtaaggagacccccagccctatgcctgaacctcaggctga

SEQ ID NO: 22556 - DNA, 565 bp, Homo sapiens
  ENST00000417065
agtgctctcttccgccttcagtgccctgctcatcaagggtctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaag

SEQ ID NO: 22557 - DNA, 497 bp, Homo sapiens
  ENST00000439814
agtgccctgctcatcaagggtctgggtgaggccccaggtcataaggaagccctcgctcgactgccccggggcccatcgcagcccccaaccagccccgagcggtctgatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctactt

SEQ ID NO: 22558 - DNA, 540 bp, Homo sapiens
  ENST00000418745
agtgccctgctcatcaagggtctgggtgaggccccaggtcataaggaagccctcgctcgactgccccggggcccatcgcagcccccaaccagccccgagcggtctgatggtgcccagggaatggtttccaaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcggg

SEQ ID NO: 22559 - DNA, 536 bp, Homo sapiens
  ENST00000430718
aatagcaaacggggcggggcttggaacggaggacaaggctcgagcctaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggt

SEQ ID NO: 22560 - DNA, 3233 bp, Homo sapiens
  ENST00000427220
cgggagaggaggcggcgacgcggaggggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtgaggcccgtgcggcccgctcgctctggcctacagcggctgcgaggacgacaagacgctggggtggagggactgggggtcgggagaagagcggctgagggtgggcatctggatgaaggcaggaggaagaaaagaggcgtggctatgggcggccagaaaagatcctaggccgagaccctaggcccagcctcagtgtaccccgcccctattccgcatctttctgcaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 22561 - DNA, 2767 bp, Homo sapiens
  ENST00000426895
cgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctga

SEQ ID NO: 22562 - DNA, 756 bp, Homo sapiens
  ENST00000426827
agatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggtaaggag

SEQ ID NO: 22563 - DNA, 1041 bp, Homo sapiens
  ENST00000431204
agatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatca

SEQ ID NO: 22564 - DNA, 545 bp, Homo sapiens
  ENST00000422738
attccgcatctttctgcaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcagg

SEQ ID NO: 22565 - DNA, 1674 bp, Homo sapiens
  ENST00000430390
gctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 22566 - DNA, 4176 bp, Homo sapiens
  ENST00000483051
aggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcataggtaaggagacccccagccctatgcctgaacctcaggctgacagagcagggctgaagctctggctcatattggagagaaacaggcctctcttcatgccctcatctgcctgccccagcagatttccctttccaccctcaatccttatccttccctaatgtgccctcccttaataagcctcttagcttggtcaactctgacctccagaaaagcttgggtagcttggcttatattctagagcaggttctaaaagttggtcagtcccttgagtttggaatccagaacagattccaggcttatatcaagttccatttgttgaattgggttccaaaaaaggctgcaggctttggatttctaaggcagactaggttccgattccacaatatgttctaaattcaggttagaatttggatccagattctatgctagatttaaattacattcagaatctgaactaggacacagtctggttctcaggacagaataagtatcaaaagtaggtgatgaacagaagaaacaaatcagacaatgggtccaagccagattctgaaggcagaatatgatccaagtcaggtcagatttggggtctggttacacaactgaaacaggagcaagttcttttttttttttgagacggagtctcgctctgtcacccaggctggggtgcagtggcgcgatcttggctcactgcaagctccgcctcccaggttcccgccattctcctgcctcagcctcccgagtagctgggactacaggcgcccgccatcacgcctggctaattttttgtatttttagtagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaa

SEQ ID NO: 22567 - DNA, 1561 bp, Homo sapiens
  ENST00000310252
cttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttga

SEQ ID NO: 22568 - DNA, 5282 bp, Homo sapiens
  ENST00000496526
tttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggtaaggagacccccagccctatgcctgaacctcaggctgacagagcagggctgaagctctggctcatattggagagaaacaggcctctcttcatgccctcatctgcctgccccagcagatttccctttccaccctcaatccttatccttccctaatgtgccctcccttaataagcctcttagcttggtcaactctgacctccagaaaagcttgggtagcttggcttatattctagagcaggttctaaaagttggtcagtcccttgagtttggaatccagaacagattccaggcttatatcaagttccatttgttgaattgggttccaaaaaaggctgcaggctttggatttctaaggcagactaggttccgattccacaatatgttctaaattcaggttagaatttggatccagattctatgctagatttaaattacattcagaatctgaactaggacacagtctggttctcaggacagaataagtatcaaaagtaggtgatgaacagaagaaacaaatcagacaatgggtccaagccagattctgaaggcagaatatgatccaagtcaggtcagatttggggtctggttacacaactgaaacaggagcaagttcttttttttttttgagacggagtctcgctctgtcacccaggctggggtgcagtggcgcgatcttggctcactgcaagctccgcctcccaggttcccgccattctcctgcctcagcctcccgagtagctgggactacaggcgcccgccatcacgcctggctaattttttgtatttttagtagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaacttccaagttgtttgaatctggtcatgtgaaaacctatttaagccttggtttccacatctgaagaatggaggtctgaagaaaaatataaaaaacagtgaagtgggtactgttactacccccattttgcagatgtgaagagcacacagacactgggatggttaactgagactatgcacaaagcacttactactgcggcccccgtaactagcgccctcagagcagccctgagagataagagtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagt

SEQ ID NO: 22569 - DNA, 507 bp, Homo sapiens
  ENST00000496246
ctgaaatttgatgacctagatggaacacatgctctgatgagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttgg

SEQ ID NO: 22570 - DNA, 603 bp, Homo sapiens
  ENST00000474948
gaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctg

SEQ ID NO: 22571 - DNA, 579 bp, Homo sapiens
  ENST00000452823
gaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaagggga

SEQ ID NO: 22572 - DNA, 2031 bp, Homo sapiens
  ENST00000443148
tcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaaggcaaggactcggggacccctacccacagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggct

SEQ ID NO: 22573 - DNA, 4834 bp, Homo sapiens
  ENST00000383827
ttcttttttttttttgagacggagtctcgctctgtcacccaggctggggtgcagtggcgcgatcttggctcactgcaagctccgcctcccaggttcccgccattctcctgcctcagcctcccgagtagctgggactacaggcgcccgccatcacgcctggctaattttttgtatttttagtagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaa

SEQ ID NO: 22574 - DNA, 3811 bp, Homo sapiens
  ENST00000473661
ggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaacccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 22575 - DNA, 2848 bp, Homo sapiens
  ENST00000455274
attctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagggcccagctcctaacatgcaggtgtcaccagagagaaatgcaccactgtgcccagcaccatagctctggctcagagagtttgcctgagaaagcagcagacagaaaacaaaaggtgcgagttgctcccgaaggaactgacttcatgtgcaacagagctcggagaagtccaaggctaagcacactctccagaacagtggaggttgtgctgaaaggcaactgggaggcgacggagagcctgggaggtgcgggctacactggaggccagcaagtctgccagagagaaacagaaaaaaagacaggtgggaagagctctcctggggtcagaacaaagcttaatatcttctttgacaaagaacgtaacatcaaaatagccaactatgggtttagttcaacatttgcaaagagagacaacactgaaaagggaacgtttgatgggactctcccttatgcaggcccagaactcttcttgggccatgggtaccaatgccctgccatcaacgtttggagccttggcatcatcgtatgcaaaatggtggctggggccctgccattttatgagcagaactgtaaggatatactg

SEQ ID NO: 22576 - DNA, 1743 bp, Homo sapiens
  ENST00000438141
gccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagg

SEQ ID NO: 22577 - DNA, 2097 bp, Homo sapiens
  ENST00000430793
gccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactg

SEQ ID NO: 22578 - DNA, 693 bp, Homo sapiens
  ENST00000602338
ccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccagtgagtcccctgcagctgggactttgggctgtgggcaggtgcttagggatagaccctttctgtctcgtgcagcccctaccccttccccaagcctcccgctcgtttaccccgctgttctgctcaggaaccctcgaggactcccactgcctccgtgatagggtctgggccacttttcttggttcttggcatagcatagtcactaagagcatggactgtgccaccaaatggacagcacattacccaaagtgtgtgttgtgtggatgttaattctacaggaagtaaatagattttatgaaaaaa

SEQ ID NO: 22579 - DNA, 882 bp, Homo sapiens
  ENST00000482269
gggcattcgtgaaaatatatggaaagcccttgtcacaatgcctggcacatagtggtgctttatcattaggaactggaatgattaaattctgtcaaagacagttttaatgtaataggaagggggtggcacaggtggagtgttggagtagggggtggtttgcagttaatggaattttatcagcctttcccatttgtgtagtctgggcaggttaggatttccggggtggcttgaaggtggggccggaggcttgggagggacctatggatatctgcagggagggcgtgaccaaggctgcctggatgacggcgggggatggtggaatatatctccccctgccctctccacctgcatgtcccaggtccagccctgcccaagttctatcatttccccacagcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagcc

SEQ ID NO: 22580 - DNA, 1549 bp, Homo sapiens
  ENST00000492440
agttaatggaattttatcagcctttcccatttgtgtagtctgggcaggttaggatttccggggtggcttgaaggtggggccggaggcttgggagggacctatggatatctgcagggagggcgtgaccaaggctgcctggatgacggcgggggatggtggaatatatctccccctgccctctccacctgcatgtcccaggtccagccctgcccaagttctatcatttccccacagcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagatttttttttaacagacagggggcggtctcactctgttacctaggctggagtgcagtggcatggtcacggctcactgtagccttgacttcctgtgctcaagcaatccttcctcctcagcctcccaagtgtctgagaccacaggcatgtaccacagctgatttttaagttttttaatgtagacatggggtctcactatgttgcccaggttggtctcaaactcctgggctcaagcgatcatcccaccttggcttcccaaagtgctgggattacactatgcctggcccctccaacagatttgaccgagtgtgtaccttgtgccatgcactgttctgggcacttggggtatagcagtgaacaaaacaagatcccagctctcaagggcttacattctagcagggagaaacaggcaagcaagaacacaagtgaaattatctaacaggttaaaagattatttgggccaggcgcagtggctcatgcctgtaatccaagcactttgggaggccgaggtgggtggatcacctgaggtcaggagttcgagaccagcctgaccaatatagcgaaaccccgtctctactaaaaatataaaaattagccgggcgtgttggcgggcgccagtagtcccagctactcgggaggccgtgacaggagaattgcttgaacctgggaggtggaggttgcagtgaactgagatcgtgccattgcactccagcctgggtgacagatcaaggatctgtctcaaaaaaaaaaaaaaaaaaaaa

SEQ ID NO: 22581 - DNA, 616 bp, Homo sapiens
  ENST00000466245
cagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctgctcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtc

SEQ ID NO: 22582 - DNA, 543 bp, Homo sapiens
  ENST00000471058
acaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagt

SEQ ID NO: 22583 - DNA, 762 bp, Homo sapiens
  ENST00000493241
cctgggcaacaagagcaaaactctgtctcaaaaaaaaaaaaaaaaaaaaaacccagccaaatgagtattgtctcctccaaagtagtcactctgcctcacagagtgacttatttcaaagatgacctgatttcaaagatgccaggacttaagcccaggttgctctctccagcgcccacgcttttcccactgcagtattctgcctttgccttcaagcagtcacctctcggggaaagaactaacacatgtccagcacttaacagtttgccccataccgctacctgcccagctcctttagtgtttacaccaacctagcaaggtaggtgctattatccccattttccagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaatt

SEQ ID NO: 22584 - DNA, 4168 bp, Homo sapiens
  ENST00000557636
gtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgtccagtatctgcacagtttcagtcgtcaaaggccaagcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaa

SEQ ID NO: 22585 - DNA, 1595 bp, Homo sapiens
  ENST00000286650
gggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcatt

SEQ ID NO: 22586 - DNA, 4683 bp, Homo sapiens
  ENST00000298832
gggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctattttt

SEQ ID NO: 22587 - DNA, 3989 bp, Homo sapiens
  ENST00000556173
ggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagtttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggac

SEQ ID NO: 22588 - DNA, 572 bp, Homo sapiens
  ENST00000554185
agcaataaataactaaaacaacttactgaacaaccaagcagtcccacttctagagaaataaaaacttacgtttacagtaaaacttacaaaaacgtacattcatataaaaatctatatggaaatgctttatagcaactttattcataatctccaaaaattaaacaatccaaatgccttcaactggtgaatggataaccatggtacatctatacagtggattactactgagcaagaaaagggacagaatactgatacatgcaacaatgatacatttcaaatgagttgtgctcagtgaaagaagctagtctcaaaaggatacacactgtctgattccacttatttgactttctggaaaaggcaaaattataaggacagaaaacaaatgaatgttttcccaggggctggaggtgattgggagggtccactacagggggacttgaggtcttatgaacttacccggaaggaccgactgtacaaaaacattattcgaatgcagcatacacatggattcaaggcttttcacatcctcccccagaccttcctcctgccagctgagtacgcggaattttgta

SEQ ID NO: 22589 - DNA, 2155 bp, Homo sapiens
  ENST00000555422
atagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacagaacttgattaatttctcttgaacttgaaagattcttgaaagattctctgcttctacttccacttgctacttacactcaaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaagttttatcttgttgtttttctgtggggtttgggcactgggtaggaaacagaacaaatggctgaaaagaaatcaaagaagaaagttgaggaagaagaggaagatggggtgaatatggaaaactttcaggagttcatcagacaagcaaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaac

SEQ ID NO: 22590 - DNA, 528 bp, Homo sapiens
  ENST00000554935
tttccttgaaactctgttcctggcatttaacctgtttcccttctatcaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcat

SEQ ID NO: 22591 - DNA, 705 bp, Homo sapiens
  ENST00000554148
tgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgtccagtatctgcacagtttcagtcgtcaaaggccaagcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggaca

SEQ ID NO: 22592 - DNA, 445 bp, Homo sapiens
  ENST00000554878
gatttgtgtgccaagatcctgcccagcgggcatcaactcggccaatttatcccacctttgagtcttccaggcgaaaccctttccagaaacctcagatgacctccctcatcatcatgtagaagctgaaatagccaagatcctcttctgggatcagtgatggacagggcccatttggctgccttcttggagtacccagggtagtcacgtttgtgccaggcctcttgaagtccagcaaccacagtgatagccttttggccacagctcttttctgtgttactgatgtctctcatctcaatatttccccctcaaattgtaaaacatttcacagcccaactttttcatttgtgatataatagattgttccttggttttgtgtcttatgtctcaattctcttaattgttcatctcctgtgctaaaaatatacccactgaaataaatacacat

SEQ ID NO: 22593 - DNA, 513 bp, Homo sapiens
  ENST00000556976
gatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcatta

SEQ ID NO: 22594 - DNA, 3071 bp, Homo sapiens
  ENST00000556893
gaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggccaaagatgttgtaacctgggagacttctctgaagaaagaaaactgtttaagaaacacagactgaactgcagtacttttccttaaatagctgagatgaccttctttaccctgggcttaggtgattctcatcagggtgacctgagtggaagttggtggtaacgactgttctgtgtcagcacccaggacagtggtgtctgttaaggctgccagggattagcagggaggaaagccatcaggactgggtagcctggtagcaccaaatcccaattaatgttacctgaacatgtggtgaggtcagccgtatgatgaaagatgtttaagagattaatgtcagaagaatatgaaaataaacaccggcttaaaaaatgtta

SEQ ID NO: 22595 - DNA, 2624 bp, Homo sapiens
  ENST00000554510
agatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggcc

SEQ ID NO: 22596 - DNA, 339 bp, Homo sapiens
  ENST00000555018
aacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaa

SEQ ID NO: 22597 - DNA, 431 bp, Homo sapiens
  ENST00000608522
ggaccactcaggtagcttgaagaggatggatttggaggatgaggcagtgccactcctttttcctccatgctcgctggtgaagataatgaggaacagtgaactagctaaaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaa

SEQ ID NO: 22598 - DNA, 547 bp, Homo sapiens
  ENST00000557219
atttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacaggttagtgggcaccagctcttctgcaactggatagatgacagggaaggtgttgggcttggcacattctctcttctgcctccaaagagagccccagttcaaagaatgaaacatctagcctctcaaaacattggcaaatgggcatttttgttgcattcttctttaaaatagtcttggcagcctaaaataggcattttctggaactagcttggggtaaatgaaacctcgccatcttataaaatgctgtcagatttgcagcatttaatacagatgtcccatattg

SEQ ID NO: 22599 - DNA, 719 bp, Homo sapiens
  ENST00000554972
gccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacaggatctttggatactccccaagttattttcgccacatccaaacccttgcccacacaatctgaagcccttgctacagttataggacagagaaaatcaaagtcggtgaagtcagggccaatttaagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgc

SEQ ID NO: 22600 - DNA, 556 bp, Homo sapiens
  ENST00000554487
agagggtcctccgcggaagggcagctgaatggactccagagcagccttaaccctgcagcctttgtgcccatcaccagctctacagaatgttgccagaagatactaccagggctgcccagatcagttggaaaggccttagggacaaatctttaagagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggcta

SEQ ID NO: 22601 - DNA, 689 bp, Homo sapiens
  ENST00000556685
agtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggtaaacgcctgcgcccgcgcgcttccctaccctagggaggagcattcccgggtccgggctggcgcctgcagcaggacttcccgctcagagcccgggagtagctgttggcttccgggcgcgccgcgttgaatcgcggctgcggggtcgtcccgtccttcccggggggagcatctgcggacctacgtgggattggggtgagctgggggtggggctgagaagcagattcctttcgggagaggagtctccttaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggaggtgcgtat

SEQ ID NO: 22602 - DNA, 1961 bp, Homo sapiens
  ENST00000556977
cgcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctacccagtagctgggaatacaagcttgcaccaccatgcccggctaatttttgtatctttgggagagacgaggtttcgccatgtaggccaggctggtctcaaactcctgacctcaattgatctgcctgccttggcctcccaaagtgctgggattacagacatgagccaccacgcccggccagaagaagaaatttttctggtacggaacagcactctgcaaatcaaactgttgtgttcatatccctgagcatgaatgaacactttctaagggctatatagacatggatggttttaaaggagatagtttctggttctctttcctaaagttgagctgcttgggagtacctcatgaggatgggtttgcctttcttacttccccttcacagttactgttttttcacttttattaaagaatggctcacctagaatcttagtctggtatattgtccttaggtgtagaaattttcagggttccaaagaaaggtagaaaaaaattagtgtctaatttaattctagtaatagcataacaaatcctttttgcatgatggtagtttctatttctttgtttttaaaataattgaaggatgatataatctagctattagctgatcattaaacataattttgatgacagatcattttataattttttgatgtgtaattaggaaggagttcacagagttgagcgtcattggtgtttggatgaattgtatactacaatacttgcaatgataatcagtcatgtatatataaacagttatagccttacggtcacagggaattaaaaatatatgccaattcctatgtataattttgctgtacagaaggtatgatatgatgtaaaagacaagtattaaatacgttaggctaacctgttgtttgtgggaaatgaaagaattaaaaacaagagtgactgggggatagtgtctgtgtggcagtctgagggaggcttttctggcatgctgggaatgttctatacagaacttgagtggtggctacacagttgtgttcactttgtaaaaattcattatgccctgccgtgttctttgtatacttttctgtacatacgttaacttcattaaaaagcatatttt

SEQ ID NO: 22603 - DNA, 286 bp, Homo sapiens
  ENST00000556265
tcaggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaagaatctgtgccatccaaattgcttgatccagtgaatctgctaggaaaggtctctgaggcccccgtctgctgactgcatgacaaaccctaaaggaaatgccaatcgtgatg

SEQ ID NO: 22604 - DNA, 182 bp, Homo sapiens
  ENST00000554132
tcaggtctgaatgctggtgctttttatgccttgtccactcttctgaatcgcatggtgatctggcactacccggaatctgtgccatccaaattgcttgatccagtgaatctgctaggaaaggtctctgaggcccccgtctgctgactgcatgacaaaccctaaaggaaatgccaatcgtgatg

SEQ ID NO: 22605 - DNA, 592 bp, Homo sapiens
  ENST00000555290
aatcagcggttgccgctgcctaagcctctccccaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccc

SEQ ID NO: 22606 - DNA, 283 bp, Homo sapiens
  ENST00000521138
agctgcggccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcgggctggagtgcaatggcgtgatctcagctcaccgcaacctccgcctcccagg

SEQ ID NO: 22607 - DNA, 2338 bp, Homo sapiens
  ENST00000260116
gggtagctgcggccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaactattataagtggagagcagaatgtccagaaataagtgcagatctacaccctagaagtattattggcctcctaaaggctggctaccatggagtcctgagatccagggatcccactggcagcaaagttcttatttacagaatcgcacactgggaccccaaagtttttacagcttatgacgtatttcgagtaagtctaatcacatccgagcttattgtacaggaggtagaaactcagcggaatggaatcaaggctatctttgatctggaaggttggcagttttctcatgcttttcaaatcactccatccgtagccaagaagattgctgctgtacttacggattcatttccattgaaagttcgtggcatccatttgataaatgaaccagtaattttccatgctgtcttttccatgatcaaaccattcctgactgaaaaaattaaggaacggattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttactttttaaatgcttttttctctacttttgaagtaattaaatgtcagtacattttaagagcataaaaatcggcgattttgtacttgaagagaacatgaaagttattgctaaagtagctgctcatgtgcatctttgtatgtttctagaaagttatattttaaacaagttctctgattaaattggtttagaaaaaaatttagaaatattccgcttaaaaatactagcacaagtcagctaatgataaaaaaattaacacttgttttaagtggatgtcagattaaattataattcattataattaaaatctgaatagagttttatggttattcctgtggaccagcaagacatttcatctcagggaaattttattttagtatattaacacgatagaaactttttttttttttttcagacagagtcttgctctgtcgcccaggctagagtgcagtagtgagatctcagctcactgcaacctctgctaggattacatgtgcacaccaccactcctggctaagttttgtattttatatagagatggggttttgccacgttggccaagctggtctcaaactcctgaactcaagtaatttgcctgcttcggcctcccagagtcctgggattacagtcgtgagccatcgcgcctggccgtgatagaaactttcagctgaggagtctatatgccatactactctatgtggcatctttaggtctctgtgaaatcatgttgatgtaattgattaacaaaaataatttagaaaatacgtcaggcacagttgatggcttctcaatatctgctttgcatttttaaacaaatcaagaatgtaattttaacttttgcttatggtcattcttatgactacacggaaagggatggaatcatacttacttgtcttatacatggactgtttttagttaacaataacgtaactacacaaaggaaaggaaatgtttacattttaaaaaattactgtcaattacatctggtatttttcagattatgcataaaataatatgagtttgactattgtatcagaatattttaatcaaatcctgcaatttatattaacttaaaaaaacatctggtaaagactgggtgtggcagctcacacctgtaatcccagcactttgggaggccgaggctggatggatgattgcttgagcgcaggagttctagaccagcctgggcaatacagggagaccctgtctctatttcaaaaataaataaataggccccggtgtgtgatgttccccttcctgtgtccatgtgttctcaaaaaaaattaaaaaataaaaataaaaa

SEQ ID NO: 22608 - DNA, 1628 bp, Homo sapiens
  ENST00000455084
agggcagtgaacctaagccaggagctgcttaggcattaaggcttctatacccagaatcgtgtgctaagctttctctccaagtcagcacaacaaagcaaaccagagcatcgtaccaacaacctgaaaggtcacctgactccttccttctcactcccattctgtacttctgcatacgtgggcaggcaagtgaatggtaagtaagcctgcaaacagcctttctttgtatagggaatgacaggcatttcatcagcaactccaggatggcaggccgttatcctgaaacctatcagaacagctcctgcttggcttccaaaatatcacaattttggaaatgtacaaaggttagttttcacagtccttgaagcctctttccaccctggccatagcccatgtcagcagtaacctatgtctttgttttacatatcatgttgttttactcacctggtgcctccagtgccctatagggtccctgagctgtcctgatactctttcttagatcctgtcaaaacactcacttcaacaaattctgcccttggactctgatgggaggttctgataaagaaaattattgaaaaccgcattatttaaatgtggttatatttcagctggacctggaaataaagacgaaatactgcttcgtgactgtgctttaaggaatttttgcttctaggagatgattgtgagccaggcagaggtgaaggagcaggagcaaatagccaaggcacagttcacagtgctggattttcttgtggatatagctgcattgttgttccttctgccttgtccaactgcttcctggtatccctaccctcaccttttcgttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaattcattttatacttaaccctttaagtataaagtatatacttcaagtataaagtgtaaggttgcttcatttcatgggcccacccaggatttaaaggtgtattccctgaaagaattggttccttccggtgggttcctggctgacttcaagaatgaagctgcagacacttatggactgggaggaggcccacgagaaaaacaggaagaacaagagaaaggctgaggctctagtggctgctttgcagacttgcagagtccaggatcccccaggaacttccactgattgctacctgttaccagtgttaaagccagggcactttaagaagaattgcccaagccacaagaaaaagccaccttgaccacttttgtggtgaagaccactggagattgcactactgaccaccaagacagagacacaatagcgaatctagaagtggaagtgtgagagatacctgcagctgttaagatgtctgggaatagacacacaaactctctctcccagataagcaacacaaagcagcacagagcaacagagactgaaagtctgcctacctgatcagggaataag

SEQ ID NO: 22609 - DNA, 340 bp, Homo sapiens
  ENST00000439472
ttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaagtatgtaaatagaatccagcccctctctgccacagcctcagagcaggattggtaactccaaaagacaccaggacacatcctaattttcttaaatttta

SEQ ID NO: 22610 - DNA, 1495 bp, Homo sapiens
  ENST00000324446
caaaagcaacccttcttgctccaggcatgtgcaggaggttttttggtttcagcattttgttgcatgctgactatgtcctttaccttctcttaaattatgtatcaattcatgctggtttattcacttcctgatgtctatatgaagaggctgtctgccaacatctttcatcactctgcctgcaactatgaaaaatttagttctaaaaaatgcaaccttgctaaattgagtactaataggattggttcaattatgttctatgtctgttccatattgacattgtgtgcatctttgccatgcaggctttttaggaattatcgcatctctaacttcccacgagtgtttatgaaaatgtttagatttaaagaactttattgctttagacagaataaggcatgcagttctaacagaaagatccatgaattccagaaatatcactgaaaattattgacatttaagattattttctgtttgttactatggttcacaattcaagaataactctggccaggtgcagtagctcacaccctgtaatcccagcactttgggaggctgaggtaggcagatcacttgagctcaagagttcaagaccagcctgggaaacatggcaaactcccaccattacaaaaaaatacaaaaattagttggtcatggtggtgttcacctatagtcccagtgacttgggaggctgggatgggaggatctcttgagcccaggagatgcaggcttgcagtgagccatgatcatgccactgtactgcagactgggtgaaacagcaagatcttgtctgaaaagaaaaaaaaaagtaaaagaaaaagaaaagaaaataactcccattgctaaagacatatatgcttatcaggttaagataaagtgaattttgttcttcccaatgacatttcaggatatttgttcacaggaaagaacatgttgggaattggtactggctagaaatttctgttgagtatttattaccccatggtaataatggtaaaccacagtttagaaagattttttttttgacagccacagcatgttccgaagagatgattggaagatggaagtggagggttaaataatgaaatgcagctaacatttcggaaagtttctaaaagttgtacaacatgccctacagctactctttaaatctccaaatcaaatgagtttcaggtggagcctctgggaggtgatgaggtcatgagagtggagcctcatgaatgggatgagcactcctacaaaaaggattccagagagctcgcttgctccttccacagtgtgaggacacagagggaaggctctgtctatgaatgagaaagtgggtccccaccagacattgaatctgccgcatcttgatactggacttccagtctccagaactgtgggcaataaatgtctgttgtttattacctgtccagtatctttggtattttgctatagcaacccaaatggactaagaaaacaccagaggccatacctaataaaaatattgacatcacaa

SEQ ID NO: 22611 - DNA, 544 bp, Homo sapiens
  ENST00000454875
cgccacgggctgcatgggcagcgctcgcgccccgccgctgagccgccggggagccgtccagtcttcgaatcccaccacagcatgttccgaagagatgattggaagatggaagtggagggttaaataatgaaatgcagctaacatttcggaaagtttctaaaagttgtacaacatgccctacagctactctttaaatctccaaatcaaatgagtttcaggtggagcctctgggaggtgatgaggtcatgagagtggagcctcatgaatgggatgagcactcctacaaaaaggattccagagagctcgcttgctccttccacagtgtgaggacacagagggaaggctctgtctatgaatgagaaagtgggtccccaccagacattgaatctgccgcatcttgatactggacttccagtctccagaactgtgggcaataaatgtctgttgtttattacctgtccagtatctttggtattttgctatagcaacccaaatggactaagaaaacaccagaggccatacctaataaaaatattgacatcac

SEQ ID NO: 22612 - DNA, 860 bp, Homo sapiens
  ENST00000452584
gaggaaagcggcggcggtggcggcttcaacagcagctcttgcccttaaggaacaatgaaacacaaagatggtgcagacccaggccctgctttgactgggagaaagatgcattcagttgactaaaacttgaacagggcagtttacttctatagaagggtgcaccctcacagatggaccaatgtgtcaggagaattcagtcacacccaaagcaggaggtaataagacaccgaagtgaggacttcacaggctgcttgggagaagacaatcatccgtgggcttgggaaagggagaaatgcctactgagtttagggaattgcttgctggaagaaatgatggcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaacaagactttctgcttgtatatgatgatgttagtatgctgacttacaaggttagatcattttgatatgtgtgatgtaggttttcaaagctggcactgttttatgcttcaaatattatttttattcattggttctcatgggatttcatcactaagctgtaaatcaataatcataatgttgaggggaggggattacaaaatagctcttcaaaatcatctttgcatttctcaataaacagcattcccttttggactacagtgaaaaatattgagctttgtttactttgaaaatgagtcttagtctatgaatgcctgggtagggtcaagaatgaaaaatgagaggaagagagaagcatcaggaagataaaatgatcaatctcacaaa

SEQ ID NO: 22613 - DNA, 515 bp, Homo sapiens
  ENST00000331787
ggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaa

SEQ ID NO: 22614 - DNA, 920 bp, Homo sapiens
  ENST00000447937
cggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagaaacacaaagatggtgcagacccaggccctgctttgactgggagaaagatgcattcagttgactaaaacttgaacggtcggctccaccagtgcaaggattgtgcctgtcctcttcccgggctgatcttcccctgtgcctggaacagcacctgctatataaattatgtgctggatacacacactcgaaaagcaagagatcaggctccctgagaaaggcagtttacttctatagaagggtgcaccctcacagatggaccaatgtgtcaggagaattcagtcacacccaaagcaggagatgcgggaggccagatgcgcaagatggacactcggctcctccttcgtccccgcctctcctcgcttccagggtagcagcctcaacaagggaaactattgttccagtggaggctgcgaggatgtcggtgatttacgcgccgagctgtagctgcaaaaggacaagggcaagtgccggcccgacctagggcccaccggtctctggcttgctcttgtgagtaggtgcaccctgcccgcttgtggtggcctcaggggtaagaaatcaggacccacccag

SEQ ID NO: 22615 - DNA, 471 bp, Homo sapiens
  ENST00000610801
ggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagtaagagacgccgctggcctagggacagtggttggggctggcccggggcattcgcgcggccttgcagcctgcaggccttcccagccgacagagctgctg

SEQ ID NO: 22616 - DNA, 630 bp, Homo sapiens
  ENST00000457658
tttttttttttttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgttcagtctttacagaagctgacgagagatttccttgtattttatggtggtatgattggccttagagcacttcagttttgagatctctgctgtatttgtatacaagtattttggaag

SEQ ID NO: 22617 - DNA, 5284 bp, Homo sapiens
  ENST00000440408
tttttttttttttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgagtcactgaaaactaagctgcgctttcctaaagtcctgcgaactgaagccagacaacttaaacctcagaagaaaataacagcaacctatttatatacataagccactttcatacctgcctactgttgtatagacttcagagtaatgtggcctgtatcgattttccaggagtattcttttgtgtgttgttttttctcaattcctcctattttctctttacaggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagataggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaaggtcagttgataggatgaatgaaaaacaaaaattggaagtaatggtactagtaataagtggggattttcatgtaggtaaaggaactgataagtcatagggaatccgtgagttcttaatcttactgagtttagttgtgttctttgattattttggatagctttgtttaacggtgaatgaaatgattaaaatggaaaaattaagtgcagaaaatatgtttaacattatataggatgtcttgttttaggcatttattgctagataacatatgtccattcttgtattgctataaagaaatattggatactggctaatttataaataaaagagatttattggctcatgattctgcaggctgtacaggaaatatgattctggaatccgcttggcttctggaaaggcctcaggaaacttagaatgatgacacaaggcagaggggaagcaggcacatcttacatggcaggagcagggagcaagaaagagtgaagcgggaggtgctacacacttttaataatccagatctgagtcaggcatagcagcttatgcctataatcccagcacttttgggaggccaaggcaggcagatcacctgagggtcaggagttcaaggccagcctggccaacatggtgaaacctcatgtctactaaaagtacaaaaattagctgggtgtggttgcacctgcttataatcccagctgctcaggaggctgaggcaggagaattgcttgaacccgggaggcagatgtttcagtgaaccaagattgcaccactgcactccagcctgggtgaacagagtaagactctgccttaaaagtaaaataaaattaaattaaaattaaaaaccagatcttgcaagaactcactgtcagaagaacagcaccaagggtatggtgctgaaccattcatgaaggagccatcctcaagatccagtcatctcataccaggtccacctccatctaatattgggaattacaattcatcatgagggttggtggagacatggatccaagccatgtcacatattatcctgactgtagtggtttaagataacaatttttatctcacaatttattttgaatacaggcatgatttagctgtgtcctttggttcagtatctcttcaaagctgtaatcaggtttttcatgtgtttgtcatcaactgaaagattgactgagtatggttctgagatctctcaggtgattattggcagaattaagttccttttcgattcttggtcttatttcttcacccatctactatagtgcattcttgccatgcagccctttttatggagcaagtcacaatacagcagcttgcttcattagggcaagcaagcaagacaagctgcagcaaatgcaagtaacatggaagtctttataatctaatcatggaattgacatagttaaaaacaaatcattaggtaggctccaaattgatcagaacatggttattggacaaaaccatgactgtcaggaggctgcatcatggggagccattttacaagcagcaccatgggtgttatgggggattttattacatttgttctgctcttaagagttgaaagtctttaaaaatgtgtaagtctgtcgtttgttcttgacttctgtcatgttttcaagaatgcattatgcaatgatgtagaatactgtttgtaaagtagttgtctagactctagtgaaaataattacagataatctcagttcatcaacgaatcggtatattaatgtcatatttaacagttataggaataaactaagcataataataaatgatgatttgaatgttattataatta

SEQ ID NO: 22618 - DNA, 882 bp, Homo sapiens
  ENST00000417071
gtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgaca

SEQ ID NO: 22619 - DNA, 630 bp, Homo sapiens; identical to SEQ ID NO: 22616
  ENST00000457658

SEQ ID NO: 22620 - DNA, 5284 bp, Homo sapiens; identical to SEQ ID NO: 22617
  ENST00000440408

SEQ ID NO: 22621 - DNA, 882 bp, Homo sapiens; identical to SEQ ID NO: 22618
  ENST00000417071

SEQ ID NO: 22622 - DNA, 4840 bp, Homo sapiens
  ENST00000258796
cggcgaacaaagaggcggcgggcgcgggcggccgagcggagccgagcgcagccgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 22623 - DNA, 4537 bp, Homo sapiens
  ENST00000407643
atggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacagggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 22624 - DNA, 560 bp, Homo sapiens
  ENST00000400376
cttttgtgttcagagacctggggagagccacactggaaggccgtgcttggagccagacagggctgtgtgtccgatggggcgcctgtatgcagcctgtagcagtgtggggccagccccaccatctcatccagcgtgggggcacgccatggacggtgcccacccctgagtgcagcttctcggtgcacagaccccagacaggatcagactcctgatggggcctcttccatgttcacccctcagaaacactttcatggtcagcaagagggggttcagtcccccacaggctcccaatttccctaccagacctgaaaacctcaggactacagctggggtgggggatcctgccaggactcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacgggg

SEQ ID NO: 22625 - DNA, 4263 bp, Homo sapiens
  ENST00000403167
tttgctctcagcacctagtacatgaggcctgatgggcagggtgtggcccagggccactggaggtcacaggcagtggctggagttcccctaatgggagcctttctcaagaactgacaccagtccccatgacccagacgctctgaatgccctctggggtgccaggctgctggcctcagctccccctcaagggcccctggcgccccactcccaggccccgggtccctgtgccctggcgcactcccaggtttgcctgcaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 22626 - DNA, 731 bp, Homo sapiens
  ENST00000477439
caggtggctgggctacctgggcctgctgctgctggacgtcatcatctgcctcctggtgctggttggcctcatccgcagctccaagggcatcctggtggggtgagtctgggggtgtcggccccccgtgggcccaaagcggaggggcagggcaaggcaccatgttaccccttcccccacctcatctgcagatcctagccacaagctctgcggtgggggctgagcgggacccccctgcactgggcctgctctgagatgccccttctgtgcctgtggcctgtgcccctgtggccagcatcccagcacacttgcccccagcccttgatttcctgcaagagtctgcacgtggggcacttgtagcccaggacctgaagcaacctgcccaggtctccgagtgcctggggccacccagagaccaggctggggctccttcctccaccccttccatccttggccctggggcagcctgggttccagccccagctccggctcactaggagggtgaccttgggcaggtggcttattgttgctgggccttggtctcctcgtttggaaggcagagagagcggcagctcctctgtgggagggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggg

SEQ ID NO: 22627 - DNA, 587 bp, Homo sapiens
  ENST00000498454
gtcttgctggtgtccccgcgttggagggtcctggggagggagaggcgggcggacccagcagcgcccatggacttggtctcctctctggagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagta

SEQ ID NO: 22628 - DNA, 756 bp, Homo sapiens
  ENST00000429448
gaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcacgctatctggctgccctggactctggcagccacgcgggctggcagtttaagcccatggacagtgcccgaacgctgtggtagctgttccctcagagcgacagtacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgcca

SEQ ID NO: 22629 - DNA, 582 bp, Homo sapiens
  ENST00000426208
agcttgccaagcacacacggccctagggcgcccagctgagacggcaccttggcacccgggcccgctgcagcccgctccggtcagctgcaccccagtcaggagcctttccagcgggtcggaggagaacggaagtttggggagacccgcgcgattcgcctggctgcattttacatttctttctccggcagctggggtcacgaaggctgctctcgccggcggtgttggaacgtggacacgtgcgctttgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggag

SEQ ID NO: 22630 - DNA, 1518 bp, Homo sapiens
  ENST00000316027
tttgtgacctgcccgcccctccccggcactgtgatgccggggggcagctgcgggcccggcgcgcctgtccccggcgtccccccctcccggtgtgtcacaacggcggaggcggctgtatctggagcagtcggggcgggcaggcccagctgagagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttg

SEQ ID NO: 22631 - DNA, 2018 bp, Homo sapiens
  ENST00000330423
aggcggctgtatctggagcagtcggggcgggcaggcccagctgagaggtgcgcgggcgaggacagcggcagcgatgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgtcctaggcactgagagctggagagttggtgataagcgagacgaacacatttcctgccctcatacacacataaataaagtgaatgagatcatgtc

SEQ ID NO: 22632 - DNA, 1700 bp, Homo sapiens
  ENST00000416740
ggcgtaggctgaaggagagtttctgccatgatcgccagttcttccttgggccttcttcaccagtgcaggaatcttgtggtttggaattagccccttgcttcatctttgcaaccaccctccttttttctttcctggtataaaaggtcaaccctgggaagcaacctttagagcaaagcacaaaacagctgtgtcttctttggatctaagtcctggtccagctgctatagagctggggcacctgcagcctcaacgccaactggcaatggggggctggggcctggctggcctgcaaggtgaatgttatggggatgtagggcaaaggcatgctgggggcccagactctctgacctcgttgcttccctctccccacagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaa

SEQ ID NO: 22633 - DNA, 1391 bp, Homo sapiens
  ENST00000608634
ctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattgccaaaggatccagttggggatctcctgttcatctatgacctctttggtctctgccagtctggagccgttcctcaaagctgtctttgattttcatgaatcgtttgaagatggcagaccagctgatctgcagaatgcccctcgatttgggttggccaggacccgcgtcctggcgaaggggttccggttactgaccttcgatgggaacagcacagaagtgataccgcgctggctccactctgtcctctggtggcacgcaattccagtgttccccgcactgatgactttcttgtaccgaatatttacattaattacattctttatagttataatgtaatattacatatgagaccatggggttcatctgattaggtctgcccaatttagcctgccctgcttgctttgggtcacttgcttttgttattttttttctgtgaagctgaaggccgcgccactgagcgctgtaacttaaccttgccggcttccttacagataacatgtatgtcactactgtcatgatcgttcaaattgtttttcaggaacttggggcagctcctgcctagttcaaaccagttgagaccgtgagctttcaagtaggcttgtgcaaacaaaagaagtggccttttgacatcagaggccccaagcgacaccctcagatcacgctaaggctgtcattttttgaacatgtgccctgtgaagtgccacgaaccctgactatgcttgcagtggtcaccgactgcctcattttcccccactgccaatcacctttgcccataccttacaccaccctgcttctctcaccggtaaatatccctaagacttatctttggggaggaagatttgagagctgttctcctgcctcctcactgggctgccttgcgaataaatcttttctcttttac

SEQ ID NO: 22634 - DNA, 2020 bp, Homo sapiens
  ENST00000259818
ggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagca

SEQ ID NO: 22635 - DNA, 1923 bp, Homo sapiens
  ENST00000473006
ggaaatggcgccctagaaaagccaggatgctactccctccgccgatttgtaggacaaagcaggcaaagctctctcgtggaagctcggctctctcagtcccgaccgaggccattataactcaaattcacaacctccggggatgcgaaaacacccggccttactgaggaacaaaggttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttg

SEQ ID NO: 22636 - DNA, 2552 bp, Homo sapiens
  ENST00000264071
atttctgcgggtggccaagcctggctgggggctgggacgggggagactgcactggtggctccctaaggggcctcacccccaaggcaggggtcggagcacgtggcgtcccggacttctctgggaggccccctggggagggaggtccctgcaccacctccccccaccccagccccctccatcatcccggggcgggaccaaggggcggagcgggagggtgaccggccgtgacgcgtgccccgcccgctcatatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 22637 - DNA, 562 bp, Homo sapiens
  ENST00000594276
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccc

SEQ ID NO: 22638 - DNA, 579 bp, Homo sapiens
  ENST00000594075
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggc

SEQ ID NO: 22639 - DNA, 530 bp, Homo sapiens
  ENST00000600216
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcgg

SEQ ID NO: 22640 - DNA, 1050 bp, Homo sapiens
  ENST00000595324
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggtgagtcccccagcagggagccagaggctggaaaacctccttattcctgctaacaccacagagtcaacagccaccaccggggcccacagaccagagatggggtggacagggcaccaggcaccagccctgcatccagggctgtgatgaggggatgctcaggccactgtgagagccctgaggagggcggatacagagaaggattcagggaagtcttcctggaggaggtggcattttaattcaacggtctgaaccggaaccagactgcctgggtgcacatcccaattctgccacttcatgcattcaacaaacagtgagcactcactgcataccaggccctgttctagaagctggagatccaggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgag

SEQ ID NO: 22641 - DNA, 590 bp, Homo sapiens
  ENST00000601152
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtg

SEQ ID NO: 22642 - DNA, 565 bp, Homo sapiens
  ENST00000598006
tatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagac

SEQ ID NO: 22643 - DNA, 545 bp, Homo sapiens
  ENST00000596291
cttcttgctgcctcatcctcgccccgacaccatgcctctaggtcccccgttcaccttgctgggggagaggtggcagctagggagctagttgggggctgggggcagtcctcggcttggccaccggcttcccctctctcaactcttccgaccacctctctctctagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccgga

SEQ ID NO: 22644 - DNA, 636 bp, Homo sapiens
  ENST00000597686
tgcagcttcaggacaagccctccaggaacctaccgccccccacccgcaaaccagatcgccgctccggagcccccagcccactgggagggctcgcggttactgcaaggattctggcgaatgaggtctaaatagaatgagaaggggggctgcggaccgagaaactgagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaagga

SEQ ID NO: 22645 - DNA, 548 bp, Homo sapiens
  ENST00000596926
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttgtagagacggggtttcaccgtgttagccaggatggtctcgatctcctgacctcgtgatccgcccacctcggcctcccaaagtgctgggattacaggccaatccggagccggcaacaactgggcaaaggggcactacacggagggcgcagagctggtggacgctgtcctggacgta

SEQ ID NO: 22646 - DNA, 553 bp, Homo sapiens
  ENST00000594290
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttgacagggtctgtctgtcctgctgtcacccaggctagagtgcagtggcatgatcacggctcactgtcacctccacctctgggcacacgtgatcctcttgcctcagtctcccaagtagctggacctacaggccaatccggagccggcaacaactgggcaaaggggcactacacggagggcgc

SEQ ID NO: 22647 - DNA, 543 bp, Homo sapiens
  ENST00000601640
actatgcagcttcaggacaagccctccaggaacctaccgccccccacccgcaaaccagatcgccgctccggagcccccagcccactgggagggctcgcggttactgcaaggattctggcgaatgaggtctaaatagaatgagaaggggggctgcggaccgagaaactgagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacgga

SEQ ID NO: 22648 - DNA, 565 bp, Homo sapiens
  ENST00000598635
acccgcaaaccagatcgccgctccggagcccccagcccactgggagggctcgcggttactgcaaggattctggcgaatgaggtctaaatagaatgagaaggggggctgcggaccgagaaactgagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacac

SEQ ID NO: 22649 - DNA, 978 bp, Homo sapiens
  ENST00000540184
attccgggctcgaaggctgtgcggtctgccaggagctgcggccccgtccggcccgggctgtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccttttcctcattctgtcagaagactgaagacacgggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatg

SEQ ID NO: 22650 - DNA, 548 bp, Homo sapiens
  ENST00000544943
agccactctagcgacggcggggaagagtgtctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggca

SEQ ID NO: 22651 - DNA, 1229 bp, Homo sapiens
  ENST00000538354
actctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaat

SEQ ID NO: 22652 - DNA, 1373 bp, Homo sapiens
  ENST00000545331
actctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctataaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacga

SEQ ID NO: 22653 - DNA, 3076 bp, Homo sapiens
  ENST00000448120
gcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaatg

SEQ ID NO: 22654 - DNA, 1951 bp, Homo sapiens
  ENST00000397132
ggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaattta

SEQ ID NO: 22655 - DNA, 542 bp, Homo sapiens
  ENST00000541678
cattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacacagattggccggcaccaatcttagtcaagagtggctgtgatcacatttgtgatcaattatgagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaa

SEQ ID NO: 22656 - DNA, 449 bp, Homo sapiens
  ENST00000538704
cccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaa

SEQ ID NO: 22657 - DNA, 2930 bp, Homo sapiens
  ENST00000504119
agagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacagtgaacagaataaacaataaaggtgcaatgg

SEQ ID NO: 22658 - DNA, 3197 bp, Homo sapiens
  ENST00000503525
gtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacagtgaacagaataaacaataaaggtgcaatggaaaaaaata

SEQ ID NO: 22659 - DNA, 767 bp, Homo sapiens
  ENST00000554321
atgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcgatctcagcccgctgtcgccttctctctgaccctggtcccttccactgcaggctgttgctccggtgtctctgggctgctccaccacgtggtgcctgcccatcatggcatccaccaccaggtggcctttttcttggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaaca

SEQ ID NO: 22660 - DNA, 731 bp, Homo sapiens
  ENST00000503191
gaagatctgcctccttcctcttcggcttcatgcatgatcgtaagtttcctgaggcctcctcagccatgcttcctgcatagcctgcagaaatgctggagtacaatggcaccatctcgactcaccacaacctctgcctcccgggttcaagcgagtctcctgcctcagtctcccaagtagctgggattacagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtg

SEQ ID NO: 22661 - DNA, 3683 bp, Homo sapiens
  ENST00000382020
gcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacctaacccactatatccattttgctcatgtgttttatgcaaccagctttccatcaaatcctcaatctttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagca

SEQ ID NO: 22662 - DNA, 1627 bp, Homo sapiens
  ENST00000515859
ttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcact

SEQ ID NO: 22663 - DNA, 1546 bp, Homo sapiens
  ENST00000506802
gtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatg

SEQ ID NO: 22664 - DNA, 1452 bp, Homo sapiens
  ENST00000510836
tcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaact

SEQ ID NO: 22665 - DNA, 1266 bp, Homo sapiens
  ENST00000509380
ctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgacatcttagcagtatactttatctggataaagtgatgactatcgaaacacatcaggaataccgagctgaaggatgaaaagctgtgttgagatcatccttttattgtatggcaggaattctccaaggtttaatttcatggatcattgacatcaagctgagatttaggattcaaataaatttcacaagcagtgtgaatgttttcatatagatcttagcagtgatacataaaagaattaaaagtctgtattctcttta

SEQ ID NO: 22666 - DNA, 1498 bp, Homo sapiens
  ENST00000503731
cggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggat

SEQ ID NO: 22667 - DNA, 727 bp, Homo sapiens
  ENST00000507400
agtttgatctcagactgcagtgctagcaatgagcgagactccgtgggtgtaggaccctccgagccagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtg

SEQ ID NO: 22668 - DNA, 493 bp, Homo sapiens
  ENST00000509177
agaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcaggtaaagagttatatcgtattcatatatttaacatagttgtttgtggtcgatacatttttgtttgtcacataaaaatacaattcattcatcgtctgaacctgggaggcggaggttgcagtgagccgagattgtgccactgcattccaggtggaggacagagcaagacttttacacacacacacacacacacacacacacacaca

SEQ ID NO: 22669 - DNA, 1203 bp, Homo sapiens
  ENST00000511783
aatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcaggcaaaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttcattctatctaggaaaaatgtagccaaatcttttttcccattaacaaataatgtaagccttaatattcaagggtaataaaaaatacaagtcttccaaa

SEQ ID NO: 22670 - DNA, 457 bp, Homo sapiens
  ENST00000508446
tgacttctggccagatgtggaaccatatccgtggacctccatatgctcataagaacccacacaatggacaagtgtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaa

SEQ ID NO: 22671 - DNA, 573 bp, Homo sapiens
  ENST00000507316
agtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttcattctatctaggaaaaatgtagccaaatcttttttcccattaacaaataatgtaagccttaatattcaagggtaataaaaaatacaagtcttccaaa

SEQ ID NO: 22672 - DNA, 555 bp, Homo sapiens
  ENST00000511342
tactgcagatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttataggtaatatctttatactaacatgaatgtttttatttttaactaatagaacagagtttcagtggttaatatataattaaggatgaatgtaaagttgctgtgtggtttttttaaattcagttaagcaagtttttgagcacctgccatgtgttcagcatagtgaagtacacaaaggagatataaggcatggttcttgttccctgacagcatgtagtttctttctagacatacatatttttatataacaaatgaggtttaagctcattttgaggacttgaaaatttttatcttcccttagtttgtcgtgatttcgacttcatttgcaagattgttttctcatataattcactgttcattgtctaataaactttgtattatcttttg

SEQ ID NO: 22673 - DNA, 3942 bp, Homo sapiens
  ENST00000222567
aaaacgagcgccggggacatgggattgtgcttgcgtcaacggcgcgcgccgtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggt

SEQ ID NO: 22674 - DNA, 427 bp, Homo sapiens
  ENST00000462263
ttaactttgtggatgtgttctttatgttacgctctttcttccttcttcttcccagggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatg

SEQ ID NO: 22675 - DNA, 1000 bp, Homo sapiens
  ENST00000407724
agagttatagggccccgcgttaagtccatgagcttccgtgagggtactctgccggttttgctgcggaagtcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatt

SEQ ID NO: 22676 - DNA, 2098 bp, Homo sapiens
  ENST00000459719
gtgagggtactctgccggttttgctgcggaagtcacctcgtggcgtaggggagaggtaacaccgagaagaggcagcggcggtggcgccaagacgattggtgccaaacagggcagaacgcaactcagctctggggtgggttcctgtccagaggggtagagaagagtggctgagggcgcgccctgatctcagcgggaagagtgcgaccccgagggcgcgctagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataat

SEQ ID NO: 22677 - DNA, 832 bp, Homo sapiens
  ENST00000447520
tcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagtta

SEQ ID NO: 22678 - DNA, 1915 bp, Homo sapiens
  ENST00000445715
tcacctcgtggcgtaggggagaggtaacaccgagaagaggcagcggcggtggcgccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttactggaggaaagcaggaatgttcagaggcaaatgaagattctgcagaataagcaagctcagattgtcaaagagaaagttcacttgcagagtgaatacagcaagaccatcttggcaagaagcaagctagaatctctttgcagggaacttcagcaaaattaatgtcaaaataagacattaaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagagcaaattaataaagcgttcaaacataaggaattacgacaacagcttgtagatgccagacttcaacaaacagcacagctgataaaagaagctgatgaaagacatcagagagagagagagtttttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaa

SEQ ID NO: 22679 - DNA, 2018 bp, Homo sapiens
  ENST00000538014
gtagctgcagctgcgcattgcacccccagctacgcagtctcctttccttctcagtcacaggaccggatggcaagtggccgcagccagtcggtgagaccgactgagctctggggcttcagttcttgacgctacctacatggctacatctccagccaaggatgagaggatgcagaaataatatttgtgttgttttaaaaatcttagatcaattaaaaagaaaaatgactctgtcattctttgtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttgtgagtatttatttaatggagcaaggaacacagaaaataaaatctatgtgtgcttgataagatttttaaatattattttgatgtaactttaaatgtaaaatgatattttatctcaaaattgaaaacaatctcctttctttagtacttatgattggtgtgtgtgacttcatcttatgaaatgatgtatagaacataataatacttttttaaatgtgaaataaatttcctaaaacttaa

SEQ ID NO: 22680 - DNA, 2761 bp, Homo sapiens
  ENST00000447202
tttccttctcagtcacaggaccggatggcaagtggccgcagccagtcggtgagaccgactgagctctggggcttcagttcttgacgctacctacatggctacatctccagccaaggatgagagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggtaataatctctgctctgtggttggatgttgtcacatactggtctttttgttttacattttctgcagcatgagtgattatgaacttggcctgtttggaggtaaatgttgcctggtaaacttgtttcttcacttggtttagtccacctatcatctccagttatgtgtagggaacaaaaatagcaaaatacgaagcccagttataagaaacttaattatttctctgtgtaacaagaactgaagttttaagaaagtttgaggccaatatgatgtaattagtatttgatttaccttgctttttgtacctttgaaaataacctaatagtatgaaaacaatatgtatgctaattttgcttaaaagattatacactgaaatttagagaggatataatgttatctgtagtgtagaaagagttaaataagactgatttttagaatttgttttatcccttccactcttagcttgacaattaggattaagaatatgatatgtcaaatttcatgactgaaatctgaaatgccttaatagttgccctcagtgtttcatccttatactaacatttacattgatatatatgacttatatgtgacactgaaacttggaatttttattcttaatccattttctgttaccctggaagacaaaaaaaaaagtatggtaatatataaagtaattgtaattccttgaaaataagacagatatcttcaaaattgatagccccaattatatgtgtaaaatatagcttgaggttaaaattatttaaaaagttttaaatgaaaatctttatgaaaatgtcagttatattatagttgtttcttacacatacacattcaataacaatatttatttattcttttttctagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttgtgagtatttatttaatggagcaaggaacacagaaaataaaatctatgtgtgcttgataagatttttaaatattattttgatgtaactttaaatgtaaaatgatattttatctcaaaattgaaaacaatctcctttctttagtacttatgattggtgtgtgtgacttcatcttatgaaatgatgtatagaacataataatacttttttaaatgtgaaataaatttcctaaaactt

SEQ ID NO: 22681 - DNA, 699 bp, Homo sapiens
  ENST00000588613
agatgggctgtcattctcttgcccaggctggtcttggtatactgtcctgtagcagtatattttggctacctgtactggcattggcttttccaagtgtcaagattacaggaaaagaagttttattattgatgcaagccctaaacactctttcgactccagaggagaagctggcagctctctgtaagaaatatgctgatcttctggaggaaagcaggaatgttcagaggcaaatgaagattctgcagaataagcaagctcagattgtcaaagagaaagttcacttgcagagtgaatacagcaagaccatcttggcaagaagcaagctagaatctctttgcagggaacttcagcaaaattaatgtcaaaataagacattaaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaat

SEQ ID NO: 22682 - DNA, 510 bp, Homo sapiens
  ENST00000589075
ctggtcttggtatactgtcctgtagcagtatattttggctacctgtactggcattggcttttccaagtgtcaagattacaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataata

SEQ ID NO: 22683 - DNA, 378 bp, Homo sapiens
  ENST00000585549
tacctgtactggcattggcttttccaagtgtcaagattacaggaaaagaagttttattattgatgcaagccctaaacactctttcgactccagaggagaagctggcagctctctgtaagaaatatgctgatcttggaacttcagcaaaattaatgtcaaaataagacattaaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggc

SEQ ID NO: 22684 - DNA, 336 bp, Homo sapiens
  ENST00000587095
cctgtactggcattggcttttccaagtgtcaagattacaggaaaagaagttttattattgatgcaagccctaaacactctttcgactccagaggagaagctggcagctctctgtaagaaatatgctgatcttgaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggc

SEQ ID NO: 22685 - DNA, 453 bp, Homo sapiens
  ENST00000488280
aaaaagcagtgtactagaagctggaggaaagcaggaatgttcagaggcaaatgaagattctgcagaataagcaagctcagattgtcaaagagaaagttcacttgcagagtgaatacagcaagaccatcttggcaagaagcaagctagaatctctttgcagggaacttcagcaaaattaatgtcaaaataagacattaaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccc

SEQ ID NO: 22686 - DNA, 7299 bp, Homo sapiens
  ENST00000253320
atagtcagtgtgagtttgagaaagaaaaacacactgtagagctctactataaaagttaataggatagattgttaaactacattctgccatctttggctatttggttgctaaatactttagaatattacttacagctaggctgattataacagaagaaggattaagtatgacagcttgtctcaataatggaagtaaaaagcagagatcctggaaagaatctgccatccatcagaggaatttgtctgactttgtggtattgctagggggtgtatggttggagtattattttgatggtgctggatcaccctcatcacagtaaactcaagaacataggacagcttgtgaaataggttcttacttgtaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataacctgcttatttgtttttattttttctttacttttagaggtctatacatagggtaagatttcaattttcaaaggatgcatccccttcctttattatgctttaagctagtaaaatatatatttaaatccttacttagtagattaaaattggaaatagaaagtgacaatttaaaaattaataaaacagtaaatattactttatgcatatcaaaatgttattttgagttacaccttttcatgctacttttgaaaacatttttctttaagattttgagtatcttttaaaccattttcctctatgtttcaagaacatttcaaacttattatggaagctgcaaacttatagtagaatatatcacttggctttagcaattatttacttttgtttctagcaactcttgtttccatctatttttaagcaaatccaagatattatatcattttatttattactattcaaatatgcatcatgaaataagattctttttaagccataatcactgtactatttttactccaaaaggttaaacaattgctatgtaatcacataccttctcactgtactatttaaatatctgttacttcccttttccttcaggttgtttacatcaacatcaaaataaggtttatacattttattgttttaatatgtctcaagtctttttagtatataagcttcccccccctcttttttttccttggaatgtatttattaaagaaattttttaggcctatatagtgaacttttaaaattaaatttgttttatattataaagcatattatgaatatcatcagtttttttaaaagaatcctttaaattccattgttttaaataatggtattaaaaatgattaattttattttattttttattattttactctttaggatttatattattttaactgtattaaactctccaaatttgctatagaagtagcagattgggagaggacatgtgttcaagttgtactacttgtatgtcttgtttagatattacagtctttttcttttatcagaaaataattgaataatgataaaatcagttgcagattaagacagattatctgttgcagtcttctcaaaacttaatttaagtacattattttcagctagcatttcttccttcacatagaacctccatgtgtggagggatttcctaatgagtctattgtatgtacaatagcacttaatgacatagcttttaaataataacaggattttaccaaatgtttaatatgtgccaggcatcaagcaccttacacagtttaattattgcatagatttggacagcaactctgcaagttaggtatggtcatgaacctttgcagataaggaaactgtgtttcacaaggagaagaaattgtcctggatcatacaataagctaggatttgctccagaccatttttttcattttatcaggctacctacaattaaggaatttcagaagattttgtgaacaaaaaatgtccaggaattatgtgtgtaataaatgaatttgatattttgatctccttatccatctttttcttgataaaatatcagcttttttttttccaatgtagggcagaagcaagaagtacagatattttgatggggacagcccacgtctgatagggtgggacatggggcagcagttagagggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaaaagatcgccaaaattgtaaccaaagccatttaaaacaaactcctcacttaacatagtgccagggcatgcaattttgtttcttactctctggatgtgggatatgcgagtgtgtgtgtgtgtgtgtgtgtgtgtgtattaagctttctgtttctgatgaaattttcatatgaaatttactggagataagattaaattagtggaaaaacaagataattttgctttctatgtagtggtcaccaagttaaagaattgtgccagttattaggcaagataggctttgagatttagggacagttaaattttacaccaacttagtgaacatgagacttctacctagtgttacatttcatttttaaataagcaatttaaaaattggtaaatgatttgtttactttgattatattctggtataattttctgacaaaattatctgtgtcttggtcagcattgttgctagaatatgtattcagattttgtctgtccataattgagaacacagaaaaaatctaatttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgtatcattctggagttgtaatatgtatagtggcaggggattccaagctatagaaaaaacatgagtctagaatgacagagtgtgtcatcttcaaatgtgtattaatatatttcttgatgatgagaccaatatttctaagttaatggaactattttattacacctgataatcacagttcaattcttgtctgttgcagaattatctacctctttcaaactgtaaatgaaaataactgtgaaaaaaaggatgcagtactgataaaaacactgctttgtttttatctcacctcttttttaaggatatgattttataagaggcagttctcttttgcttttcaagacttctgtagagtttgtgttttttgtttttgtttttgtttttgtttttgtttttttacctaatgtgaatcttattttatctactcaacttcgttcaggttaactaaagatatagatataatggttaa

SEQ ID NO: 22687 - DNA, 1074 bp, Homo sapiens
  ENST00000593000
gggaaaataatgtggaagaaactaactgtggagcagcatcttacttatatttaattatagtatagtgaatatctggatcagcagatgatacttattttatagtagggcatttgcttttctctaattatctacttagaaaaagctgcttgcttttaaatgagagatttctggtcataaataagggggaggaattatagtttaaaagcaacacctcatgggagcaataaatgaactcacatagcagtagcttctttttcgcgagctttatctgtaggtctgtacttttaacatacattattttggataataaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataa

SEQ ID NO: 22688 - DNA, 841 bp, Homo sapiens
  ENST00000592697
tataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcaggtcacgtatgtttgtcggcacatgcaagaaatggttcaaaacatgagggacatatacagaacctgtgactacttgtggtcagcacaagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgacccc

SEQ ID NO: 22689 - DNA, 2926 bp, Homo sapiens
  ENST00000582401
gacgtttccgcctcctgcttgaaactaacccctctttttctccaaaggagtgcttgtggagatcggatcttttctccagcaattgggggaaagaaggctttttctctgaattagcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaa

SEQ ID NO: 22690 - DNA, 1509 bp, Homo sapiens
  ENST00000488537
gtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcc

SEQ ID NO: 22691 - DNA, 509 bp, Homo sapiens
  ENST00000486597
ccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctca

SEQ ID NO: 22692 - DNA, 1225 bp, Homo sapiens
  ENST00000425134
atgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaaga

SEQ ID NO: 22693 - DNA, 3504 bp, Homo sapiens
  ENST00000269601
agcacgcacggcgtcggtgcgtgcgcgcccagacgttctgccgggtggcagtcccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcggaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagtactgtaagtgaaaagccagttactacatattgtgtgattccatttatacggaatttctagaataggcacatccatagagacggattagtggttgcttaagactgggagggagggggaaataggaggtgacagctaatgggcagttttatttttgatgtaatgaaaatgtgcttacataagccgagcaggcataaacagaaaaagtgccctaagattgtgataatggtacaattctgtcaattgcataattggtggatgatgtgtgaattatgtctcttaggataacagctttactggcgttaccagaaaaagataaaataattacattccaca

SEQ ID NO: 22694 - DNA, 1185 bp, Homo sapiens
  ENST00000585474
gggtgggcagggcgaagactgaagcgagaagggcagcgcgaggtgggcgactaccagagcgaagcgagcggcgtgtaagcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccct

SEQ ID NO: 22695 - DNA, 752 bp, Homo sapiens
  ENST00000588162
cccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtg

SEQ ID NO: 22696 - DNA, 546 bp, Homo sapiens
  ENST00000592957
gcgaagcgagcggcgtgtaagcggggtgaagacaacgccagtcctgaccttggaaggaggatacccaccactggaggctggagccactggaaagaggcgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagagga

SEQ ID NO: 22697 - DNA, 803 bp, Homo sapiens
  ENST00000355491
cggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaagtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcac

SEQ ID NO: 22698 - DNA, 988 bp, Homo sapiens
  ENST00000585769
gtcggtgcgtgcgcgcccagacgttctgccgggtggcagtcccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaatgttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaagtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaata

SEQ ID NO: 22699 - DNA, 448 bp, Homo sapiens
  ENST00000586612
cgggtggtgttcagatcctgctgccggcagctcgaggctaggatggctggagatgtgagggcctttgtctcatcacatccgagcacagctcagcaagatgctcttagctagaaaacagattttatgtgttaatgaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactca

SEQ ID NO: 22700 - DNA, 611 bp, Homo sapiens
  ENST00000592837
gtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatgg

SEQ ID NO: 22701 - DNA, 669 bp, Homo sapiens
  ENST00000591711
gcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggtacgttatcttaaagttgttactgaaattgaatattgtcagtttggaagcttaatgtaatcaagatctctttagattattttattttgaaggaagttggttgtacagtcatgtcccaaaatcgtttgtatcaccaggcaatcagtgtgaatctttgaaataattttcaaagtaacaattctagttttagcatttactcagtaacaaattacccttttgaaataactttgcggggaaacctaggtgaagtgtaattcaatgaaagat

SEQ ID NO: 22702 - DNA, 586 bp, Homo sapiens
  ENST00000586825
tccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaataaatggcagataatggggactcttccttaccttgttccgagttctgtctggatattccagctgttttaaagttaaaaattttgcagttatttatcttgtggatattacagaagtgcctgacttcaacaaaatgtatgagttatacgatccatgtactgtcatgtttttcttcag

SEQ ID NO: 22703 - DNA, 706 bp, Homo sapiens
  ENST00000586295
gcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaagttctgcaggctgtacaggaagtgtggtactggcatttgcttctggggaggcctcaggaccttccaatcatggcagaaggcaaaggggaacaggcacgtcgcacggtgaaagctggggcggagtgtcacacacttggaacaacctcagctcactaccccgaggacagcaccaagaggatgacgctcaaccattgatgagaaattcatcccatgatccagtcgcctcccaccaggcctcacctgcaacgctgggagttacgtttcaacctgagatttgggcagggacaaatatccaaactatatcaaatggttaaaaattttgcagttatttatcttgtggatattacagaagtgcctgacttcaacaaaatgtatgagttatacgatccatgtactgtcatgtttttct

SEQ ID NO: 22704 - DNA, 535 bp, Homo sapiens
  ENST00000589926
agagcgaagcgagcggcgtgtaagcggggtgaagacaacgccagcattgctggattttcctccaatccacgaccctccgggacactgaaggaatgctatttaacagaacagtcatcgttcacgagcatctctgcgtctgtcttcaggatttggggctggctgatttggccttcctgggcctttagagatcaggtctgctacaatgtctgaccactgtgccttttccagccacttagctttagcttctgagaccagtatgtggaccagctgataaaggtctgaatgacccgggtcatagattctgataatgagctcaaactcttgagcaaacccaattggatctttacgggaggcaggaaattctttatgcctcgcaactcagccattaaccagggttgacagacaatcacaggggttcccctaactgttaacagttgttcccgaaacgggttgatcatgagaggagtccctatggtgtccccttttccatgtcttccagatgagaggctgccactggcgataccagagaatcggc

SEQ ID NO: 22705 - DNA, 1662 bp, Homo sapiens
  ENST00000323274
cgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaa

SEQ ID NO: 22706 - DNA, 925 bp, Homo sapiens
  ENST00000579128
tccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactttcaccttcagatcatgaggttgggcccagaggattttttttttttttttttttttttgagacagagttttgctctgttgcccaggctggaatgcaacggcgtgatcttggctcactgtaacctctgcctcc

SEQ ID NO: 22707 - DNA, 693 bp, Homo sapiens
  ENST00000323250
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 22708 - DNA, 1327 bp, Homo sapiens
  ENST00000323224
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaag

SEQ ID NO: 22709 - DNA, 534 bp, Homo sapiens
  ENST00000584122
agtgctggagggttagggagagctgcctgggcttgaccgcgcgccggtctcaaagtcctggctttggcccctcctccgttttcccctgtggaccattccgcttcgcagcgttttcaaaaactggagcgaaagtgatgtgggcggggcaaaggcggcgggaagaggagagcactgaagctggcgcgggaacttggtttcctggtggcctcccatccaatccccacgaaccagctttcctcttaaaccttgaaaagagaaattcgggagttcgagtataagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaagatgaattccctctgctgacaaccaaacgtgtgttctggaagggtgtttt

SEQ ID NO: 22710 - DNA, 886 bp, Homo sapiens
  ENST00000581920
aagctgctgcgtgggccaagttacttgtgcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatatttta

SEQ ID NO: 22711 - DNA, 1676 bp, Homo sapiens
  ENST00000471250
gggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22712 - DNA, 3344 bp, Homo sapiens
  ENST00000478282
ttttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22713 - DNA, 1675 bp, Homo sapiens
  ENST00000459639
ccctccctgacattgctggcacacaggcatgattgctggttccattggatatggatctggattgtcagcgtatttgaacagtattaagggagggttttgcagtagagacagaaggtgacgtaaggtggttcctaaggtgggttcggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtgttttcaagagagaacttggtcgtggagaactggagaacagatactgcctaagttacatttagttttagactaatttaatactccatttaagaaacaaacagaacagctgtgcagttaggaaagtggaggggatttgaatgaggaggaggcgggttagagttagaaccgtctttgctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22714 - DNA, 966 bp, Homo sapiens
  ENST00000464750
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22715 - DNA, 4694 bp, Homo sapiens
  ENST00000475639
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccaggtttgtttgcctttttttcatgtaaattataaaaacttcatgttcttttcaaagacagttaatttctacatattaagcaagtcattttttctctcgtagttgtattttccatttgtgttcataagtgtgttcttttatttaaataatagtgaggcaggtgatcgacttccagtggaaggtctgagaccaccactccttgtttttatcattagagaaactttaaaaatcagtttttgatgtttgtgtgttggctgtgcctgatatttgctgccctgccatcttccctaccccctctgatagacatgggtccagagggggtggccgtgccagccttgggttagcctcctccaggcaccagtggacacggagtgggctttctgctctttgctgtctccagacagtagaggtgatggagccaccttccaagttagcgtgattgtcaccaggcccatcatgctgctcgagcttctctggctgcgtcctcactttcacatccctagctgaggaaacagcgagtcgcatcacgtcatggaaacatgaaaaattaagctgaaaggtagaaaatgggccgtaaattgctcttagcgggtctgtttggttaattgaggagtgcctgttatcttgggcttagatccgctctgagttcagttcaatcaaaagttgtgagttttgatagttttatttttggttagttgaagaaaaggcaaaggttggtacactataaaggatcacttacggattaaagggagaaggcacctctaatcggagcagaaaacttgtgcccacgttgatgagaacatttgaaatttgaaaatcgatgcccaagtctttccagatggagggctggggaactccttccaacccacccttgaagtctaaatgtgcagcctctgagctgttgagtagctattatgcgtggtccctgggagctgccaggctctgcctttgagctcacatctgtctgtatacgttttcctgtaagcatttaagaaaatctaccactttgtgtaagtgagctgggagaaggaaacatgggttttttccggttgaagcccatggacgaccccacagcacacagtgtttttagaagggaagaggatgatggcttttccctccattatgctaattaccaagtggttagtataatagcagtctgtcttttgatagctctgaacatgagtttctttttacaaatttcaaaatcttggagaactagctttacattttctgtgtattgcaattgttttttctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22716 - DNA, 940 bp, Homo sapiens
  ENST00000380276
ctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22717 - DNA, 962 bp, Homo sapiens
  ENST00000291552
cgtcgtcgcgtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 22718 - DNA, 682 bp, Homo sapiens
  ENST00000486519
gacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagcactgaatctcaactgaagcacttgccagaggcagccggtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtgg

SEQ ID NO: 22719 - DNA, 338 bp, Homo sapiens
  ENST00000463599
tgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagt

SEQ ID NO: 22720 - DNA, 3973 bp, Homo sapiens
  ENST00000496462
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaaaaaaaaaaaa

SEQ ID NO: 22721 - DNA, 609 bp, Homo sapiens
  ENST00000468039
cgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactaccattgccctcttgaacatttaccgtaaccctcaaaactcttcccagtctgctgacggtttgcgct

SEQ ID NO: 22722 - DNA, 1019 bp, Homo sapiens
  ENST00000398137
gtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagt

SEQ ID NO: 22723 - DNA, 2294 bp, Homo sapiens
  ENST00000367926
ctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 22724 - DNA, 128 bp, Homo sapiens
  ENST00000476240
gagtggccgcgcggaaggagctggagacggtcgtagctgcggtcgcgccgagaaagaaggatggtattggagggctgagcacacgtatgctgaacatatggctgcttgaactttggcctgtcgctgtg

SEQ ID NO: 22725 - DNA, 2069 bp, Homo sapiens
  ENST00000367925
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 22726 - DNA, 2066 bp, Homo sapiens
  ENST00000367924
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 22727 - DNA, 660 bp, Homo sapiens
  ENST00000474728
ttcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttgtgattgtttttagtaagatgtattgtaaggtgggaatcatcggagcccattccccagcgcattaatgggaggccaaagcatttctcccttctcaccctcccacccccaactatgtgctaggttctgttgaagcaaagcataagaaatgaaactttctttaccacagctgtgagctttttaaaaatacagatgttcaccttacaccaactgaattagaatttcaggaggtgggttcggggcatctatatttttagaaagctgcccacaaagttctaattcagctgatt

SEQ ID NO: 22728 - DNA, 1147 bp, Homo sapiens
  ENST00000486089
gtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagatgtatgtaaggggacagtgtgtaaaaactagtgaagtgctgtaaagagctaccagtaattattggcacttgccccaaatagtgtccttctgacctgagaatttcatattaacttaatcctcagggaatttagtgatcatcagggtagcatctattccatttgtttaactggaagaattatctgcaagcttctcagaggaaagttatggtttgtacttttgctctggcaagtaacatgggaagcaaagtctttaacacatacttgttttttttcttagcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaata

SEQ ID NO: 22729 - DNA, 2377 bp, Homo sapiens
  ENST00000271469
cggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtc

SEQ ID NO: 22730 - DNA, 6912 bp, Homo sapiens
  ENST00000284273
cagcccacaaggctccttttcctttttgatccattcaaaaattactcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgaaaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgaaagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagaagcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttga

SEQ ID NO: 22731 - DNA, 572 bp, Homo sapiens
  ENST00000525711
gcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcggcccgcctgtccccacgtagggagtgaagcaccaggcccagcaagccccgtggaggcctccgagatgggcaccaggagacaagga

SEQ ID NO: 22732 - DNA, 553 bp, Homo sapiens
  ENST00000526386
attggagacttagaagtcttcactttcccatccccagccccaccttcatgtctacgttgtaaaagaggctgcagcaagagggcaataccaatatctattccaggggaagaatttggtaatgatggactttcaggaataaaggtttgggggaaaagctgagatttcatcacttacaagtgagccgctgtagaagccagtcaaatgtattgcgtgacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctat

SEQ ID NO: 22733 - DNA, 987 bp, Homo sapiens
  ENST00000530917
agtaagtcgtgaggaaacagacaaggctgcaacccagcagcagttgagcaccttgtcaaagtgtgggaatgagcgtgtgtgggtctctgtgcttccagccttttctgcaccagctgttccaagcggagcagaggggtctgtcttgcttctccgtaacttcatcaacctacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatgg

SEQ ID NO: 22734 - DNA, 1032 bp, Homo sapiens
  ENST00000533451
ggtggcgtgcacctgtagtcccagctacttgggaggcttaggcgggaggattgcttgagtgcaggaggttgaggctgcagtgagccacaatcatcacatcactgcactccagcctgggtgacagagtaagactctctcaaaaaaatagaaaaaagaaaaaagaaaaccatcagcaccacttctaatactttctgccaaaggggctgaaaacaagaatctgctctgtcagggatctgggtcactaagaatgagtgggtgaagaggaaggaggaaaaaccaagacatgacaacctttagagaagcaaaaataaaactctaatgtggaaactgctgaaaatagactgcctgggctgtcagactgcatgcaaatctgatgctaatcacatggaaattaattacaagtcctaacttccatatgtcttgatatgacccttgggggaaaacctgctgcaggtgtctactccccaccacagaggattgagtggaacacaggctttgatgtcgcctccttcacactcagctcttgccactgcagggagaggaggctaaaaatattaacaatagaaatttgatttcttctttcagacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccggtgagca

SEQ ID NO: 22735 - DNA, 698 bp, Homo sapiens
  ENST00000529998
ggttaagtaattgcattatcagcctcctccagtctctggggagaggatgccaatgttaagtagcagcagacttccatctccccttgtctctgagtgaagactgcctgttttccctgccagtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatgg

SEQ ID NO: 22736 - DNA, 1163 bp, Homo sapiens
  ENST00000526493
caactaagggtgattttgtctcccagggtacatttggcaatgtctgaggtcattttcaattgttacagcttggagagtgctgctgacgtcttgtgggtagaggccagggatgctgcgaaacaccccatcatgcacaggacagccaccccccccaaaaaataattattcaacccaaaatgctgttgagagaaaccctgcattaaactttgaaaatatccatcttttcccctcatttctccatcaatctcacccagaagctaagacacgtgattccaaaatgaagggaatagagctttgggagtcacgcagctataaaacatgctttgtatttctacacaaattatttcatcactgtaggtcatagtgccctcttctgaaaggtggggctggtgaccaccaactggaatgttgtgagaaggacttaactaaaaggactgccctcagctgacccgcagctcctagaggaaagccgtatggtggctatctcttgaacagtggcttgattcggaatctcttgccatccccttacccccttattctactgctgtgaaggagagaaacgtcttttgtcttctttgttatgtgggaagcagaatttctcagggtacctttctatgcctttccttaagtcttcaccattgctatcatcaccaccttttaattactgacctttttcttcctttttccagaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcgggg

SEQ ID NO: 22737 - DNA, 532 bp, Homo sapiens
  ENST00000530578
gaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtaagtatcctggagtgactgcactccaggcatttcttgcctcctccttcaaaacactggtaccatggatatgcaagacacttcctgtgggtttctataactttcctacaagtttcctcaattcaaaaggaacttactacacaaccattaagtttaggacactgtgctcagccctgggttggttgaccaaagtgaatgaggtgtggtccttattgaggagcacgtgatcca

SEQ ID NO: 22738 - DNA, 376 bp, Homo sapiens
  ENST00000577958
agtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcat

SEQ ID NO: 22739 - DNA, 1225 bp, Homo sapiens
  ENST00000302182
gtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 22740 - DNA, 724 bp, Homo sapiens
  ENST00000577640
gctatgaggaatttggggctcagttgaaaagcctaaactgcctctcgggaggttgggcgcggcgaactactttcagcggcgcacggagacggcgtctacgtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgca

SEQ ID NO: 22741 - DNA, 704 bp, Homo sapiens
  ENST00000535788
atttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggt

SEQ ID NO: 22742 - DNA, 477 bp, Homo sapiens
  ENST00000578649
aggggcggttggctttgttgggtgagcttgtttgtgtccctgtgggtggacgtggttggtgattggcaggatcctggtatccgctaacaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtagcata

SEQ ID NO: 22743 - DNA, 1012 bp, Homo sapiens
  ENST00000395839
gtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 22744 - DNA, 1014 bp, Homo sapiens
  ENST00000395837
gggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 22745 - DNA, 500 bp, Homo sapiens
  ENST00000578706
agtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtg

SEQ ID NO: 22746 - DNA, 1056 bp, Homo sapiens
  ENST00000614404
agtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtagc

SEQ ID NO: 22747 - DNA, 3745 bp, Homo sapiens
  ENST00000536769
gttccccagctttagggccacgcccgccctgagatctgccgagtcattgtccttgtcccgcggccccgggagccccccgcgaccggcctgggaggctcagggaggttgaagggggctgagcaaaggaagccccgtcattacctcaaatgtgacccaaaaataaagacccgtccatctcgcagggtgggccagggcgggtcaggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaattggtgttttttttttttttttttttaagtttattttgcatt

SEQ ID NO: 22748 - DNA, 1303 bp, Homo sapiens
  ENST00000538617
attgtccttgtcccgcggccccgggagccccccgcgaccggcctgggaggctcagggaggttgaagggggctgagcaaaggaagccccgtcattacctcaaatgtgacccaaaaataaagacccgtccatctcgcaggagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaa

SEQ ID NO: 22749 - DNA, 2688 bp, Homo sapiens
  ENST00000339647
ggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 22750 - DNA, 582 bp, Homo sapiens
  ENST00000541272
ttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcga

SEQ ID NO: 22751 - DNA, 622 bp, Homo sapiens
  ENST00000540351
acgtcacccgttctgttggcttataatgcagggtggggccacctgccggtaggtgtgcggtaggcttttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgac

SEQ ID NO: 22752 - DNA, 548 bp, Homo sapiens
  ENST00000541645
ataatgcagggtggggccacctgccggtaggtgtgcggtaggcttttctccgtcgcaggacgcagggttcgggcctaggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatct

SEQ ID NO: 22753 - DNA, 563 bp, Homo sapiens
  ENST00000535131
ggcttttctccgtcgcaggacgcagggttcgggcctagggtaggctctcctgaatcgacaggcgccggacctctggtgaggggagggataagtgaggcgtcagtttctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcag

SEQ ID NO: 22754 - DNA, 477 bp, Homo sapiens
  ENST00000544481
gcaggacgcagggttcgggcctagggtaggctctcctgaatcgacaggcgccggacctctgatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtc

SEQ ID NO: 22755 - DNA, 559 bp, Homo sapiens
  ENST00000546271
agcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacat

SEQ ID NO: 22756 - DNA, 627 bp, Homo sapiens
  ENST00000540700
acttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgac

SEQ ID NO: 22757 - DNA, 582 bp, Homo sapiens
  ENST00000535859
tattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccgg

SEQ ID NO: 22758 - DNA, 624 bp, Homo sapiens
  ENST00000536661
gagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatcca

SEQ ID NO: 22759 - DNA, 517 bp, Homo sapiens
  ENST00000542416
gttgctgggcctctgtcccttctccattggtgccagctctgaagcaatcttttctggggcgcctgcaaaggacggatctgtgggtggaacgaactgaaaacggatccagtgactcatcccgattcttgcacattctagcacatcgcattctagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatcca

SEQ ID NO: 22760 - DNA, 718 bp, Homo sapiens
  ENST00000546120
tgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttcccctt

SEQ ID NO: 22761 - DNA, 2515 bp, Homo sapiens
  ENST00000265339
cgtccctctttctccaccccgccgagcctaaactagtgacggggagggagacgggatagtgtttctgtttcgtggtctttgaatccacaacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaa

SEQ ID NO: 22762 - DNA, 415 bp, Homo sapiens
  ENST00000510021
agtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacg

SEQ ID NO: 22763 - DNA, 818 bp, Homo sapiens
  ENST00000511807
ggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttgggtgagttgaaaggtttaacaaataatagaaacagggtctccctatgttgcccaggctgggcttgaactgctgggctcaagggatcctcctgccttggcctcccaaagtgttaggattacaggcacaagccactgtacccagctgaaattataggtcttaaggcaattgagaactttatttcagaagcttaagttccttagcagcaggaaaccccatagtatttatcaaatcatttctaaaagtatttagacccaaaattatatgacatgttaatctctgaagtaatttgttgttttgtataacttttctgtaatatattccatatctgacccctgttggtataaagaacaactatgcaaatctgttttttcttttctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgcc

SEQ ID NO: 22764 - DNA, 500 bp, Homo sapiens
  ENST00000506787
tcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtgtcttgctctgttgcccagactggagtgcaatggcacaatcttggctcaccgcaacctctgcctcccgggttcaatctctgctggatgaaccgaatcctaacagtccagccaatagccaggcagcacagctttatcaggaaaacaaacgagaatatgagaaaagagtttcgg

SEQ ID NO: 22765 - DNA, 644 bp, Homo sapiens
  ENST00000507277
cccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatata

SEQ ID NO: 22766 - DNA, 235 bp, Homo sapiens
  ENST00000504431
cggcccggaggaggctcatgcgggatttcaagcggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactg

SEQ ID NO: 22767 - DNA, 682 bp, Homo sapiens
  ENST00000499038
gaaccctcccagatgttcaggacttttgataccttgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagaga

SEQ ID NO: 22768 - DNA, 657 bp, Homo sapiens
  ENST00000503080
acattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatg

SEQ ID NO: 22769 - DNA, 4317 bp, Homo sapiens
  ENST00000399816
gcagcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgatacactgcctcaaggatccagtcattgtgggctatccttccatttaaaatatttcagatattcttaaattttttaaatattgcaaatactacaacatgtaattccagagcagcgttctaagtcaggtaccagaaatgagtcttaggaacccatagtctttgcaaaaattcagtagattgaaatagtccccagaagcagccaaggagctgaagggatgattcgatcaagttcagatgttgccaattgtatcttactgctgtgaaggaggaaaagtcttccgggataatgtattcaattcttcaggcagttttgtctacttggggacctgcccattggttcaaggttttcagagatccaagaggccttgcctcaaagaacaaggattggcgcctttcagcagggctgcccattcaccaaacttattgttacttttgtttttctttaccactttcttatttgcccccaagtgcacacaggcagctctgccagaccaaaatgacagtgtattaagaatgcagggcctgctcagcttccctgtgagtcataatagtcgtgaaacttgatgacagtgaacttacgatgttcattcatccaaccctctatggtggcattctccatcctggaaacctgacatttggctgacggtctttggaccctggagctagtggtcatcatggaattacactgtggagatgaaagacctaggacagaaacatcttgctagggaaagcacctgagtttattcctttctaaatattttcctcttctaatgaaaactaaaagcagctttactttagggggaaaaatatatccaaaggcaggtcatttcagtagtgtttattagctgattgaaaaacaggttcacggtgctctctgagaactgcaccaaggggtgcagccaagagactggtctgaccccgggttgggctgggtggcagccggcgacagagcagagagacactcagctcagtgtcgctccttccatacactcagagtttgatttttcttgcatggcatttccattaggtttgttagaaacttatagaagaaatcaattctttagtgaacgaaataccatttttcactcaattggtaagaatttttcattttaaaagcagtaggaagtgatgtaaaactctaccattgcttggactgttaggagtgcggactccctttctggtagactcccttcgtaggcaagcacggtggtgcccagccatggaggcacccttaggacactgagcacaggcctggctgcctgtgccttggccacagcctccttccaccccactgaagtggacacctgcctctggagcccagggtgagaaggagaggcctgaagcctggggccacgttcccacacaagccaaggaacctattcctctttggacagacagcgagggaataatcagacagtgggtgcaaatgttcatgtcccgatagctccacacacccatgtatctgtgggaactcaaaccaagccagagcccacagagccaaacaaacagaaaatcacaaacccatctgtcctcttctcaatgcagaactccttcccgtccaataattttcctgaaccaatcacccttgttattgggtatcttctccactgctgggtaaggcctgcacatggtctgtctgtaactttctagaagactgagaactgcttatgccttagggagttctatgtgagcagcaaggttattccccctagttacacacacacgcacatgtgccaatactcctgcaaagacttgctgtttctaaaatccactactcagaaaaaccagggtgtcggcttaaagttttcagctccatctatcaaaatttgacctttttttaagagaaaaatatgtagatgagtgaaaaagacctaggattgaaagacaaaaagccatgtgtccatgtaaccctggccagtcactccacctgcctgagccttggtttcctcagctgtgagctcctaccaggtcagtgtgggaattggccaaaatgacgcagcagaagtgctttggagactaaagattgtcaacgaaatgtaagtgtcattttcgtagtattaggacgtttacattacagcaggctttaattagaacccacttagatatcgactcagaatgatcaattacagtggttaaaatacacatacctggtaatcatatacttgctttctgtccccagttcttacattaagtcaaccaactgacccaaaaatcaaccaataactaactggccatctctccactcactcagcattctcctcttaaatgcagggcatgcagaagattaaggtacagccccttccctggataggaactc

SEQ ID NO: 22770 - DNA, 6103 bp, Homo sapiens
  ENST00000252108
taacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 22771 - DNA, 6061 bp, Homo sapiens
  ENST00000431736
cgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgactt

SEQ ID NO: 22772 - DNA, 2149 bp, Homo sapiens
  ENST00000545354
gtataagtagaggaagaaaacagcaactcagtcatagaaagggacactaagaatagcaatttttaatgccttctcaagatacctgaattgatgcagagcatttttcaaaactactcagtcaacacattgccggaagaaggaaattatgtctttagagagaaatctccatcatagacattttaaataagacagtagataaaagttcagcatgtgcttaagctgctcagctgcctagattcaaacaaaaaatgaatatcatctagtttcccaatattagctagctcaagacattatctacagggccaaaggaaatgattttggactattatccataactttgaattatgtgtcttcctttcagtagagaatattaggctgaccttttctgaagaataatttaatttaatattgaacaacagagagctggaagctgctcttagattgcatctcaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctct

SEQ ID NO: 22773 - DNA, 2113 bp, Homo sapiens
  ENST00000310473
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtc

SEQ ID NO: 22774 - DNA, 1413 bp, Homo sapiens
  ENST00000536983
gctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcc

SEQ ID NO: 22775 - DNA, 1004 bp, Homo sapiens
  ENST00000544615
gggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttc

SEQ ID NO: 22776 - DNA, 389 bp, Homo sapiens
  ENST00000545212
gggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacaggcttctgcaccactgtcatcgcctcccctgtagacgtggtcaagacgagatacatgaactctgccctgggccagtacagtagcgctggccactgtgcccttac

SEQ ID NO: 22777 - DNA, 344 bp, Homo sapiens
  ENST00000545562
aaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacag

SEQ ID NO: 22778 - DNA, 567 bp, Homo sapiens
  ENST00000543714
actgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacaggtgaggggatgaagcctgggagtcttgatggtgtctactctgttccctccccaaagacacag

SEQ ID NO: 22779 - DNA, 464 bp, Homo sapiens
  ENST00000539764
gggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcc

SEQ ID NO: 22780 - DNA, 538 bp, Homo sapiens
  ENST00000542615
actgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggctctccagatgaaccacagaagcaggaatgtgggcatcatcagtgaaatctctgcatacagcagacaaagggctggtccagtggctgtttatgaggcagcgctaggagagctctgatccagactctccctgcagtgaaagggagggagcccttcatgaagtattgactgcttgagcaggaattgcttcaccagcacctaactgagtgcctctcgagctcacatcggttttccctcatgaggccacttggagtcttgct

SEQ ID NO: 22781 - DNA, 536 bp, Homo sapiens
  ENST00000541027
actgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggctctgacctggacccctcatccctgcctgtcttgtggtgtaagtgcggatccccctaagttggaggaaaggaaactggcccaaacaaaaaggagagcagttttctctgcatcacatgctctccagatgaaccacagaagcaggaatgtgggcatcatcagtgaaatctctgcatacagcagacaaagggctggtccagtggctgtttatgaggcagcgctaggagagctctgatccagactctccctgcagtgaaa

SEQ ID NO: 22782 - DNA, 608 bp, Homo sapiens
  ENST00000539330
actgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagct

SEQ ID NO: 22783 - DNA, 458 bp, Homo sapiens
  ENST00000461673
tgagccctgcatcctgcccacgacccccccagaaacacctacgcaccactctcctagccgccgcagccccgccagtctcgccgggaggaacccccagcgccgcggtacaaccacggcacttccgcccgccccccgcgcctcgggcgcaagcgtttggtgtgtctgcgtcgggggcggagcctcttgtccctctgcgcggcccgttccgcctctcttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagagatttgaagattggaagcaggcctgtaagagacaacagacttgaaatttgtgatgggatgatgtgtaccaattaaataaatgatttaagcatatgtaaaccta

SEQ ID NO: 22784 - DNA, 4224 bp, Homo sapiens
  ENST00000369278
cttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaggataaaaaagatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagactttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttatttaaaataaagttacctattctactaaa

SEQ ID NO: 22785 - DNA, 2348 bp, Homo sapiens
  ENST00000514247
agttggtccgcccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcgtccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaagtataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatg

SEQ ID NO: 22786 - DNA, 1630 bp, Homo sapiens
  ENST00000264689
agttgtagttggtccgcccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgattt

SEQ ID NO: 22787 - DNA, 678 bp, Homo sapiens
  ENST00000510206
ctgagcaccaaggtgatgttttaacttcatgttaaaaacccaggcctcctttatacagttcaagaagcagaaaatcaaggtcttttagcgtcttatctagcacacttggtggccttaagtattttgagtttatgttgctttaaattgcacagtttaattgctctcagttccctaacacttaatttttttacatttatatattttttcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacatt

SEQ ID NO: 22788 - DNA, 1672 bp, Homo sapiens
  ENST00000510755
cccgggccccgcccctgggccgtgcggtgacaccacttcagggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaat

SEQ ID NO: 22789 - DNA, 1159 bp, Homo sapiens
  ENST00000511485
atttagatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaa

SEQ ID NO: 22790 - DNA, 592 bp, Homo sapiens
  ENST00000509180
acatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagcatttggaatttgaagtctataaaaggttttttgactggtgcatgtatcttactgaatatagtagcaatattcttgttctgta

SEQ ID NO: 22791 - DNA, 565 bp, Homo sapiens
  ENST00000502428
agggccggcccccggaacttttgggcaggcgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttg

SEQ ID NO: 22792 - DNA, 367 bp, Homo sapiens
  ENST00000502282
ggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgctgtaacgcccatcattgaaagggaaagcggaggac

SEQ ID NO: 22793 - DNA, 490 bp, Homo sapiens
  ENST00000505357
gttggtccgcccgggccccgcccctgggccgtgcggtgacaccacttcagggccggcccccggaacttttgggcaggcgtcagcgcccgtgtcaccgccacgtcgcggacatgaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgta

SEQ ID NO: 22794 - DNA, 4832 bp, Homo sapiens
  ENST00000376747
gccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaa

SEQ ID NO: 22795 - DNA, 512 bp, Homo sapiens
  ENST00000462472
cacatttcattgtgaaaaccttctaattcataccttcaattatttaaaagcctttaaaagacctatgtaacaaacctgtatgttctgcacatgtatcccagaacttaaagtaaaatttaagaaattaaaattaaattttaaaaaacacttcaaggttaaaaaatatatatgagctcctgttactgttaatgtatattgggtttaatattcttttatacagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaa

SEQ ID NO: 22796 - DNA, 428 bp, Homo sapiens
  ENST00000476866
ccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaaggtaattactaatgaatattttaatacatcactagattgatccagaagtctagtatgtggaagttccacaggtagtgaaaatttaagtaaggcaaaggtcctctaatctaggagggataagataaatacataaatgttactactgtgtacaagataggaaactagagctataagacagatgaaaataaaatactat

SEQ ID NO: 22797 - DNA, 833 bp, Homo sapiens
  ENST00000491509
gaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagaggggacaaaaatataccctttctcttctttgtggatcagaatcactgtcattcattatgagccattcttattgatgggaatattcagttctccttcatgtgtcattgggcagaaaacaggcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaa

SEQ ID NO: 22798 - DNA, 1493 bp, Homo sapiens
  ENST00000463054
gataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgatttatagaatttattcattctacagttaataaatactttcttagatcattcgtgtattcatgagcaattcgatggtttttagtcatattactcaatgattatttttttctcatcttaaaaggggtattttcaattaaaagcaaacccaggtgcttggatactgaggttacaccaaggaaaatctgaagatatttatcaaatagttgggtgagttatgcaggctgcttttaaatttttacacataaatacgtttttagtgtaatacaaccaagagaatcaaaacaacaattaaaatgttaagattggcctggcgcagtggctcaagcctgtaatcccaacactttggtaggccgaggcaggcagatcacaaggccaggagttcaagacctgcctggccaacatggcaaaaccccatctgtactaaaaatacaaaaatttgccagacatggtggcgcacacctgtaacttcagctattcaggagactgaggcccaagaattgcttgaatcttcgggaggcggaggttgcagtgagcagactgcaccactgcactccagcccaggacagagagcaagactctgtctc

SEQ ID NO: 22799 - DNA, 610 bp, Homo sapiens
  ENST00000465196
ctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaagtatattccagaatttcttccgaggtagtatggttttcttcataggataaagaataaaggctgtgagttaatta

SEQ ID NO: 22800 - DNA, 805 bp, Homo sapiens
  ENST00000461329
aaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaa

SEQ ID NO: 22801 - DNA, 910 bp, Homo sapiens
  ENST00000467305
gaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcctgttaagactattgcatgtttcattgataaatgtttaatggaaacatcaaatggaggacatgcagttttacaaaatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaa

SEQ ID NO: 22802 - DNA, 2240 bp, Homo sapiens
  ENST00000376712
agcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaagcttgtctattgactattgaaaatacgtgttttcaatgagacaccatctcacaccagttagaatgacaatcattaaaaaggaaacgacagatgctggaggggatgtggagaaataggaaggcttttacactgttggtgtgtgtgtagatgagttcaaccgttgtggaagacagtgtggcaattcctcaaggatctagaaccagaaataccatttgacccagcaatgcccattactgggtgtatacccaaaggattataaatcattctactataaagacacatgcacacgtatgttgattgtagcactattcacaatagcaaagacttcgaaccaacccaaatgtccatcaatgatagactggataaagaaaatgtggcacatatacaccatagaatactctgcatccataaaaaaggataagttcatgtcctttgcagggacatggatgaagctggaaactatcattctcagcaaactaacacaggaacagaaaaccaaacaccacatgttcttactcaaaagtgggactcgaacagtgagaacacatggacacagggaggggaatatcacacaccgtggcttgtcgggggtggggagctaggagagggatagcattaggagaaatacctaatgtggataacgggttgatgggtgcagcagaccaccatgacacgtgtatacctgtgtaacaaacctgcacgttctacacatgtatcccagaacttaaagtataataaaatgaaaatatgtattttgtaagttgtgctgatagtaacttttttaaattgtatttctccatttaaatctgaaatggcaccatgtcttgatttcatgagtgatagaggaaagaagattacagtttagattgtgtgtatagtaaaataccattctactacatcattatttggctctctaaaagatgcctagagatgtttaacaatgggtaaaattatcttattttagttttttataagaatcaaagatggaacttttcagaaataaactctgattgtatgaggcatttttgactttccttatagtttttattttcaattataaaagcaaggcttgcaatttataaaatgttaaacaaaaagtatgtaatatgaaaacataagtctgccctcatccttgcatcgcttacagttgacactaacaattgagagtatattcctccagattttgttttgtttcatatatttaataaaagagacctgtatatcttcctcattatttttaagttccgtgaatatagctgtatcacaatttatgattatcttaatgatgaatgattcatttatgtctaattacatggaatatgtaatttc

SEQ ID NO: 22803 - DNA, 1233 bp, Homo sapiens
  ENST00000376714
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaagtatattccagaatttcttccgaggtagtatggttttcttcataggataaagaataaaggctgtgagttaatt

SEQ ID NO: 22804 - DNA, 1004 bp, Homo sapiens
  ENST00000621375
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaaagt

SEQ ID NO: 22805 - DNA, 1547 bp, Homo sapiens
  ENST00000397618
gccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgcctt

SEQ ID NO: 22806 - DNA, 1010 bp, Homo sapiens
  ENST00000638479
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaaaaagtgtat

SEQ ID NO: 22807 - DNA, 4084 bp, Homo sapiens
  ENST00000310836
aagccaacctcgctcagcggacgactggccggatcccaacgcgctgccccttgcccagcctgcgagcgcgtggtacgaaggcgcgtctgcatccatgccccagcccggggagctggaggcgctcgcagtcagaggcgagtgatgctaggctgagcgcgtggcggcccgtgtcgtgccccgctgagccaagtgcggaagggcagcggcgcgctccgactctgctcgccgcacgcagggcggggcgcggctggggggcggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatag

SEQ ID NO: 22808 - DNA, 735 bp, Homo sapiens
  ENST00000507710
aggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagtgagagtaacacatgcgcactgtggattcctttgtgaatacataaaaggaaaagttaaaactcttataattcacactatccagagaaaaacaatactattttgctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatat

SEQ ID NO: 22809 - DNA, 2448 bp, Homo sapiens
  ENST00000394511
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtccc

SEQ ID NO: 22810 - DNA, 12946 bp, Homo sapiens
  ENST00000260323
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggagatagcagttctgtggatgaaaaggctcgaatagtaagtggcaatgatttggatgcttccaaattttctgcactccaggtgtgtggtggggctggaggtggactttatggtattgacagcatgccggatcttcgcagaaaaaaaactttgcctattgtccgagatgtggccatgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagcattgtattgtatcttctgcctttttatttcatttatgcaatatcatctcatttaggaataaaaactccaggctcttttgaccatatgtaatagtcttcatattatttggttctaacatctcattaaaagtttagatgtcagaatggttattattaaaaagtcaaaaaataacagatgctggcgaggttgtgaagaaaaatgtttgtttgtttatacactgctggtgggagtgtaaattacttcaattattgtagaaagcagtgtggtgattcctcaaagacctacaaacagaattaccattcgactaagcaatcccattactgagtacacagccaaaggaatatcaaacaaacattctaccataaacacatatgcacgtatatgtccactgcagcactattcacaatagcaaacacatggaaccatcctaaatgcccatcaacagtagaccagataaagaaaatgtggtacatatacaccgtggaatactatgcaggcataaaaagaatgagaccatgtccttcacagtgacatggatggagctggaggccattacctgaagcaaactaacacaggaatagaaaacgaaatactacatgtttgttatcacaagtggaagctaaacgatgaggacacatggacactaagggggcaacaacagacactgtggcctacttgagggtaggaggagggaaaagataagaaaaagtatctgtcacgctacgaagcttactacctgggtgacaaaataatctacaccaaaacccccgtgacacacaatttacctacgtaataaacctggacatgaacccctgaatctaaaataaaagtttttaaaaaaaagttcagatgttaaaattcattccacaggtggtgtgttcatggaaaccactgtatattgtaatgacgaggaaaataaggatgaactaatgtatctacctatatattgctaaataccgtttagtcccatgaacaaaattcaacatgcaacatggttaaaaatctcacatgataaaagttttcatcaattacttgaaaaattcattctagatttatgttataaatattttacagaacattgacttaagctctttaggagcacatattaatgtcataatacatgatacatttgagtaaaaggcagttaggatttgcattgatcactttaaattgagcaaggtattttttccctgacatgtttaattgcatccaattattctgtcttttacaatgtatacaatatatatcaaagcctaatagtggcagggtgaattaagtctatttatgactatcataaagtacaggtactaattttgaaatgattataaattctgtagactctgttttcctctcaaagcacaagtattcccgttgtcttcagaacaaagcctgttatatttacttacccaaattagtagtcactctaaggttcccagtgatctctgtcaattgagtgttgcactaatgtgtgtagcaatttattcatcttattctagataaaacacacaaaggcaaagctctgttgcttgtctatggataaacctcacattacaggtctttaaagatacacgtgtaaatcaaatttagcaaacacaaagtatttaaacccagagtggagtatttgctattcgaaggaatttgaatgcattaagtaatcagatgtccccactacaacctgcgctaatttatctacttctaggataatttataacttgaatttatcttaaatgaggcacatttataaatgacaattctaacttaatgtcttttatttggtcttttttaaaaacaatgcgtgaaacaagattttctccttttaatttctctacattacataaagatatgactatactagctagcccctttatggactactatagcagctttaatctttatgctcaaataataaatgatcatacttatacatgactcagggaatatccttgaataaatgtctaattccacctacttagaaaaattcttgggcacacaggcaagagactgccctcccctgtggaatgaattttaactcccctgatgttacctgtgtttatactcaagtcctttgtttgaaatagttgcccctttgctcttttgactccccaggcctccactgatcactcttctctgtggttcaggcttctgcagtgtgatttttagaataaaaaactaggatatgtgatatgaaggagaatcaattccaatttgcgaatgttaaataatatatatttaaaagtgctcatgttttttcacatcatgacaactttgaaatcaggatacatatataatcctttggcatgttatggtttaattggtgatttttttctcccttattagtacatgtttcttcttataatgaatgacttccaggcatcaataagcatatttattaaaaagtatatataaatcgatgaaaataaagtaatgcttagttgtctattttaaaacatagtttggctaggcacagtggctcacaactgtaatcccagcacactgagaggccgagacaggcaggttgctttgagcttagaagttcgagaccagcctagtcaacgtggcaaagccccatctctacaaaaaaatacaaaaatgagtcaggcctggtggcatgtgactgtagtcccagctacttgagaggctgaggcaggagaatcacttgagcctgggaagcagaggttccagtgagccaagatgcatcactgcactccagcctgggcaacagaatgagaccctgtctcaaaaaatatgcatattttttaatttgcatatactaaaattctctcttttggcatacatttctgtgttatgacaaatgcgtagtcatgtattaatcacaacagtcaagatatgggacaattccctcatacctcaaaattccacgttaccactttatagacaaacacttttcctactatcaaccctctgcagcactggttcattttagtccctcacgttttgtgtattccagaatgtcatataaacggaactatacagtatatattcttttgagcctgtataatttcacttagcacaatgcaccagagattcatctacattgtggcatgtataaattattacctagttttttttgttgaatagtactgcactgtatgaacattaaaaagatttcattcaccacttactacacttaccttgtttggcaatattatgaacaaagcttttataaacattcacatacaggattttgtgtatacttgtttttatttttcttgggtgattatctattagagtgtgatttctaggtcttatgataagtatatctttaacttcataaggaactttcaaacttttttgaaagtagttgtaaaattttacatttccagaagcaatgtatgagagtttcagttgctctgcatctttgcaagcactgggtatcgtcagttctttattttagttcttcttctgatatacacaaaatagcatctcaacatgcctttaatttgtattcatctgaggactaataacattgagtatctctgtgtgtgcttatttgacatccatatattttgtttagtgaagtatctgcaaatcttttgcccatttatttaatgagttgtttattgttgagtttggggacatattttcatattccatatacaaaccctttgtcagatatgaaatgtgcaactatttcatcccagtccgtggctagtcttttcatttttataacaacctctttaagagaacaaaaggttttcacttccatcaagtcgaatttgatgaaatcattttttctcttttatagatcatagctttgctaccataagaattacttgcctcactcaaggccaaaaagatttttttctcctatgttttcatatggaaattttatactttggggtattacaatttggcctatgaaccgttttgaggttaatagagggtgtaaagtttgagttaaggttcatctataattattaaattacaattgagtaattaattagaaactaattttcataggcatgtccaattgttccagcaccacacaattcattgaaaatactacagttatcacttggaattacctttgtaccttcatcataaatcaattgaccaaatgtgtgtgagtccatttctgacatctctagtctgttccattgatctgactctataccttatcaccaatgtgacactgtagcaattactgtagctttatactgtcttgaactcaggtagtaagagttctccatgttcttctcttcaaaacagtggagtattctactacttctcactctctataaaaattttaacagccagccaggcacggtggctcacgcctgtagtcccagcactttgggaggtcaaggcaggcagatcacctgaggtcaggagttcaagaccagcctaaccaacatggagaaaccccgactctactaaaaatacaaaattagccagacatggtggcgcatgcctgtaatcccagctactctggaggctgaggcaggggaatcacttgaacccaggagacggaggctgcagtgagacgagatcacgccattgcactccaacctgggcaacaagagcaaaactctgtctcaaaaaaaaaaataacagcctactgggattttgactgagaacttattaaatccatacaccaatttacaaacaaccgatgtcttaacaatattgaatcttcaattcgtgggcacagtatatgtctccacttatttacatcttcattgatttattactgtcttatggttttcagcatacaaatcctaccaaggatttcttctgtatgtgtacaagagtataaatgttactttgagaataaaattcaaaatcc

SEQ ID NO: 22811 - DNA, 1693 bp, Homo sapiens
  ENST00000561210
caccattgatgtttccatcataggagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagtaaaagtttattcctgcatgagggattttttggccagctgctctgatgcctggatttttcttcccaccaatcttcataagcagccatggagggctcagctactgacacctcctcagagaagatttccctcaccgcattatctgtagtagctcccaggaataaacttattttaatctgctgcgtaa

SEQ ID NO: 22812 - DNA, 535 bp, Homo sapiens
  ENST00000559093
ttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagaagaaggaaggagaaagattcttttatgagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttct

SEQ ID NO: 22813 - DNA, 938 bp, Homo sapiens
  ENST00000539562
cagtgactcactcacatgctcacaaattcagcaatttgttcatgatagctgcttggcggggtggataatatcctggtcaaaatgactgagccacatcagtgatgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaacta

SEQ ID NO: 22814 - DNA, 362 bp, Homo sapiens
  ENST00000560537
gaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaaccgctatgattgtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaa

SEQ ID NO: 22815 - DNA, 6841 bp, Homo sapiens
  ENST00000335350
attgtggcaggcggctggggccggctagggcgccggagccgcacgcagccgcggggctccgagaggcgcgcactggggctgggactgcgcggcgccgccgctgcgagcgccactgagcggtcgcgcaacttcggaggcacagcgccggagccaggcgagcgctcagagacccggagccagaggggcgcgccggagcctcgttcgagagccggcgccaggcacccaccgcgctccgagtgccaggcggccctccgcgcagcgtggcttccgctgcccccacggaaggcacgggctggcgctgccgggcgccggggaggacggcgaggaggaggcggcggcggcggagacggcggcggcgagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 22816 - DNA, 6451 bp, Homo sapiens
  ENST00000373192
gagactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaatgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 22817 - DNA, 3252 bp, Homo sapiens
  ENST00000404895
cggactctcgcctccgctccgtagttcggggcccggcagcggcgcgagggctgggaactgcgcggcggggactgcgggcgactccggcatccgcgctggcggcagcggtcgccgcgccgtgggaagctatggggacgcgccctttctcggggtgcccattcagcggcggctcggagctccctgccccgctgctttaggaagcgatcgtggagcagagtcactctctgaagactcccgagacccattcgactcgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaa

SEQ ID NO: 22818 - DNA, 2966 bp, Homo sapiens
  ENST00000420357
tccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctaggcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtag

SEQ ID NO: 22819 - DNA, 8662 bp, Homo sapiens
  ENST00000287272
tccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacggaaagttgttttttctaacacaacaaagtgggaccatctctattcccatctaagccactcaaattgctgagtgctattagaacacagcttattacatggatatggggacaggagagattaaagcaggttcaaaaacacatgaactgcagatgccataggcctcaaatcagctgtaattctaggagacacgtgttgatctagttatctaacattgttgttataagaaaatgagtttactgcatttttcaatccagattcttgaaattgtctaacatgtgggtactgtgtcatcacaaaatctctcagtaaggctatatgtgatcctcattttgcctcttgggaaattagcagatagtctttgctctaaatgatatctgagtaaatagacttgaggaatcctctaccacagtgtccctgaaaccacatgcatcattcaggaagccttcaccctgtgactattcagcctccctgaatatgctttctctatagaaccactaacatatggctattgctctatgatttttttttttacattaggaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatcttagatgtgttgcatattttgtgtttttacgttccaaactctttcaaaagctgccgttacaaagctgtttggctgtattgacagcatgtggtgtttttacaaaagcaattctaggagagccagtgtctaccatgaactcctgacatccccactccagggtcattcatgacattgaaatggcaacttgtacactgtaattcttcgaaaagtaacaggggatggaaatcagacctggccgttagtcactagtgtgtagtaccgtgatctgaagtaggaaatttaactgacatagaataattgtggtttttgaagcagctactcattgctttttccttttgctgtgaagatcatggattgggaatgtcctcgtgaggtggacctaaggcagtaacatttaaacttcatgtcctagcacccgccctccatctgacccaaagataaaaaaggcatcaagcttcatggttatgcctaagcttaaaaattcccttccccactactaatattgagttcagcagggccccatcttacttatttttcaaaaaagttatagctttgaattatagactatattactaaatttggtaaggtagttctttgcatgaatgggaatgtgtgtcaaaatactttcacaaaaggcatgattacaatggaaatgcccctttgcctccagttttgctaaccctaaaaagtatttcactaatttcaagcactgtttacactcaaatcccaaaattggccaaattatataattctcttaaattttcatttctgtaggtggagatttaactatggttctggtgaatcatagaagggagagacaatatttgaggggagtttatcagcagaatatcatgccttatgaccccattactgaaacacagacattacaatcagaaatagacctaataattccaatatccctccattaactagttccagtgatgctgagagacacagcaccctgtgccaggtatcagaaatataagcctcagcagagggtaactgaaaactttcaatcagaaacactctccaaggcttatggctagattatgtaggtcactaccattcaaaacttttctatacaaaggtggaaaagcactcagaatctgggaattttctggttggaagaacaatgttctccttttccaaattggaataaagactcagaattacccattcttcataatcatgtctgattggtacatacactccaggaagtctcaacctagaaacatttccaacctaagcatttaaaggaaaactggctcattcttctgacccaaactcaaaaaatatgagtacttgcgtacctccatttctgcatgaagattttaaaacagatttcatttttttctgtttattttgggaaggtgcgtgggggtgttctttcaagtgattcacatctcaaacccataccactctcaacttttatttgatgtgttcaaagccaaaaaataaaataaaataaagcagggctgaacacttaatttgacatgaagctgaaggactgagcaagccagaggagagaggttgaatgaagcatagccttggcttcataccacactttttgtgccttgtattatcaatgtaaattctgaatgttgtacagtaaacttggatggacttcttagaaaaggctgcactggcttctttttcagcacatgtacatatctataaatatatatacatatatatttggtaatgccaaacagctctgttatattgtattgaacaaaatggacggtttggatgttttatgtcgagtttgcaaaaaaaaaaaaaaaaaaaaaaactggatggttgcagacttttcaagataaatgtacagacgtaaattactgcatatcagttatttatgaataaagagtcttttattgacattttaggata

SEQ ID NO: 22820 - DNA, 3532 bp, Homo sapiens
  ENST00000416672
ggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagatggagtaggagaggcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccacctt

SEQ ID NO: 22821 - DNA, 7002 bp, Homo sapiens
  ENST00000453357
ttaaataagtagggattgtttaaaaaaaaaagctgtaatatgttatctgggggtggatgatcctggtgttagttaaagctctcagtgatgtctgtgctgggacttccgggttcctgttggacttttcctcccaaacttcaccaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacggaaagttgttttttctaacacaacaaagtgggaccatctctattcccatctaagccactcaaattgctgagtgctattagaacacagcttattacatggatatggggacaggagagattaaagcaggttcaaaaacacatgaactgcagatgccataggcctcaaatcagctgtaattctaggagacacgtgttgatctagttatctaacattgttgttataagaaaatgagtttactgcatttttcaatccagattcttgaaattgtctaacatgtgggtactgtgtcatcacaaaatctctcagtaaggctatatgtgatcctcattttgcctcttgggaaattagcagatagtctttgctctaaatgatatctgagtaaatagacttgaggaatcctctaccacagtgtccctgaaaccacatgcatcattcaggaagccttcaccctgtgactattcagcctccctgaatatgctttctctatagaaccactaacatatggctattgctctatgatttttttttttacattaggaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatctt

SEQ ID NO: 22822 - DNA, 2381 bp, Homo sapiens
  ENST00000474634
tgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctaggcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggtgggtggtaagtgtgtgtttgtgtattttccatcatttaaatgtttcatttttacacagttacttcccatcagattcattttatgatgtttactctcccctcatcagacctgcaaacactgcggctccactagtccacttgatttacacagcaaaccagaaccaatgctgagattagattttgcagtcttcatctcagcatggattgaatgctccctttgattccctgttagagctgataactatatttgcctgaaaggtttgggtagtccccaggctttaagcccctttggagtatatttcctaggcatgataagaaagcactgaaaaaattctctggcatgacagaccagggccccatgtttatacctaagcatggtttatgtactagtttgataatttagataatttagtgaaatgacatctcatcagtaactgacctaatgaacactccatagcccttgctatagtgttactttctggtgagcaacgatgaggggttgttgtagagttgctcttttgaatttaaacttcagttccagggctatgtcagtataatgaattctcacatattttgttcctccttttagctggaagagaggagattttcatgatgttttgacatgatacttaaagtatccagcccagatcacttttaaaatgatatcctttctatggattagttttcaaagttgctgcctaagacctaagtggatggtagacaaggtcaatttctgctcggatttctaagcaatgagaattaggtagtgcactgaagcaggtagtgatctgttggctgctaagagggaagagtatctgttggatctgtaagtgtttatcaaacaacaggtcagcattgagtcagggacattatagtctagacagatgtctctctagggtggagctaaccaacctctcaaatcgagcatttcattccataaataaaatctgtaataggactagtctgattctaccattctagctaactgacccctctagtagcttagagactggagactgaaattcatttctagttgatgaatgttgtcttgttctcccctagagcaattacttccttaaaatcttcatttcaaaacatattttacttcatcaaaatagccctcaatggcagccgtaattgaatggttttgttttttaaatttctaattctctaaatcttcattggtcaatgttttaggacatggtaaggatctttgttcaaatgtgtatgcgtgtcaatgtgtgaatgcctacgcatgatttaattcttccagttgataattggaagataatgagtcaatcagacatatttaccaattaacttttctgtaagaattc

SEQ ID NO: 22823 - DNA, 2448 bp, Homo sapiens
  ENST00000449677
ttgcctacacttaaactcaacttatgtgtattgtaaatctctaagacaatattagtcttaccaaacttacctgaccattttgttttatttttatttttagccaagaatatcatggaactaatgatacaagaaaaatcctttggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacgg

SEQ ID NO: 22824 - DNA, 2771 bp, Homo sapiens
  ENST00000478701
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagaagcacctttcacttcccaccatgattctgaggccttctcagccatgtggaactgtaactccaattaaacttacttatgttcccagtttggggtatttatcagcagcaagaaaatgaactaatatagtaaattggtaccagtagagtggggcattgctgaaaagatacccaaaagtgtggaagcaactttggaactgggtaacaggcagagattggaacagtttgaagagctcagaagaagacagggaagtgtggaaaagtttggaactttacctagagacttgttgaatggctttgcccaaaatgctgatagcgacatagacaataaaaccaggctgaggtggtctcagatggagatgaggaacttgtagggaactggagcaaaggtgactcttgttatgttttagcaaagagactggtggcattttgcccctgtcctagagatttgtggaactttgaacttgagagagatgatttaggttacctggcggaagaaatttctaaacagcaaagcattcaagaggtgacttgggtactgttaaaggcattcagttttaaaagggaaacagagcataaaagttcagaaaatttgcagcctgactatgcaacagaaaagaaaaaccaattttctggggagaaattcaagccaactgcagaaatttgcataagtaaggagcaaggagcctaatgttaatccccaagaccatggggaaaatgtctccaagccatgtcagagaccttcacagcagcccctcccatcacaggcccagaggcccaggaggaaaaagcagtttcgtgggctgggcccagggtcctcatgctgtgtgcagccgagggacttggtgccgtgggtcccaactgctccagctgtggctgaaaggggccaatgtacagctcaggatgtgacttcagagggtggaagccccaagtctcagtagcttccatgtggtgttgagcctgcaggtgcacagaagtcaagaattgaggtttgggaacctccgcctatatttcagaagatatatggaaactcctggatgcccaggcaaaagtttgctgcaggtgcagggccctcatggagaacctctgctagggcagtgcagaagggaaatgtggggttagaggccccacacagagtccctaatggagtgctgccaggtggagctgtgagaagagggccactgtcctccagaccccagaatggtagttccactgacagcttggatcatgcacctggaaaagccgcagacactcaacaccagcctgtgaaagcagccgagagggaggctgtaccctccaaagccacagggtggagctgcccaagaccatgggaacccacctcttgcatcagtgtaacctggatgtgaggcctggagttaaagaagatcattttggagctttaaagtttgactgtcctgctggactttggacttgcatgccccctgtagcccctttgttttggccaatttctcccatttgaaacggctgtgtttacccaatacctgtacccccattgtatctaggaagtaactaacttgcttttgattttacaggctcataagcgcagggacttgccttgtctcagatgagactttggactgtggacttttgggttaatgctgaaatgagttaagactctgggagactattgggaaggcatggttggttttgaaatgtgaggatatgagacttggaggcgcaaggggtggaatgatatggtttggctgtgtccccactaaatctcagcttgaatgtt

SEQ ID NO: 22825 - DNA, 13440 bp, Homo sapiens
  ENST00000272845
gggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaa

SEQ ID NO: 22826 - DNA, 8010 bp, Homo sapiens
  ENST00000489023
caggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggtgagaatgcctccgagttagctgttgctatcacaaatgtcaaagttaagatttgtcattttttaagatggtggatcattctggagttgaatggatgacttgaaagttttctttggtatatgtgcatagttaatagggtctatgaatgcctaagtagcaaagcctacattttgagaaaaataacattttctttaaaagtatatgtgctcatcttgaaaaaaatctatccatttcttagctatcatgctcctcatctgacacatataaaaatttcaattagtaccctttaatcccttttaaaataagggagggttggccttataaatgaaacaactaatgagaaaagaaaaggaattttatgttcaaaatactatatttaacatagctagttaacatatttaggtaccagtttagagaaattccaagctttacaataatcgccaagcagaagcttaaaaattcgcaggattgaaaacaaacacctagttttcacttttttacctaattcagtgtggtactaaatgaacactattaatgcttgatctttgttcagtgacctgggaaatattaattggtagcctacatattagcagatgtttttgaaccactctacttagagatgtgagccgagtttggaaactgtagtgatagtgagcagatagttcaacagattaacactggtaaacccacttactcggaaatttcaagtttaggttagtgagaaaattttctgtccttttaaactaaacccaaaaatcagtgtgactccttcccaagaatttatagcacttaatgttcaattcatcagaatttttcaggtattagtccataatctccttcacactaatccagctttcaggagtcattaaaaaaacaaatggaaaagttttattctaataattgattatttgtttttatattcttttataccgtggtgatgactacctatacattatttcaaggttatttatttcaatggcatggaaatgcttgttttaaaacactatttctttagtgatcccaatagaacatttgtgtctatcagcaaatggcttatcaaagatttataactgtctcacaagggtgcgtcaaaataaattcctttcttaaatacttcatatctaaagacgttaaacatctccaaaaatgacccatttatgcttcccgaaagtagatttctggattagtacataggcttggtcagttataggcaattttctcgggagataggctatgaatatggagttggcttggatttaaattcattaggtgatctcagttcaacacaagaaatgttgactgaacctgacctgcatattaccttcagtgtcggagatgtcacatagcctcatttatgaatacatttccatttgtcattgcagattccatttcgctagaaaatataagcttagaaagtattgccaggaaaatataaggaaatactgttaatatcagtaaagcccaagctgtttattttggggccacagggatgaatcagtactagaagaattatgaaatggattgacttttattacagaaaatcccatattcatttaattgggttatgtatacagtaacaccatttatactaccatagaaagtagccaaaaaatacatatcatgtcttgggaggccaagaaagaacattgtttaaataaactattttcttctaatgtgatcttcttggcaggagttaagctatataaatcaaattagtggtagtctggtgtaaaaactgatgggcgtgtgtaatctgataaacaggtttcagaaatgtagctggggtcagattagttctattgggagtaattacccctgtgatcagttttctatgatggtagtcttaggaccctctgtcaaagctaaaaccagggaaattaaaatgcaacccattcatcatctctgttttttcttcaatagatttagtcgagtggggcaggcctgcctctgctacgttttcagtatcttcttcccctcccagtatgctctgtgcttttggaacaatatgggtaaacttcatcccagagacacatcctgtcttagatggcatcagaatcactgtctcattcacttgtttcagactctccagaagggagccaagacgctaatggcgcctatattgtattccaggcgacaggttgagtgggagcctgccagcaatttgattgaaggggtttgtttgacacttcagaggcagccaatcatatccttcctgcctcaccttaggtcactgatcaatgtctgtgtcaatctggtgagtagccaagtggcaatcttatgaaactttgcacaatgtaactctgctattgacttctctgaattgaagatttacaggtcaaccactttgtgcccctatctgcccatgaaaacagacggctcaggtgacactgaaaatagtgaggtacatttcaaggtggtgtgtggggagatccaggaacccatccctacacagaagggattttggtgtgctgcttcccatgcactactttgacaattcacctcttcaagttgcgctgagagttgagggctgccagttggagagtggggtggcggagcctgcacaattggctagaagttgaggtagtctggggtggggaacttaaaatgcaaagaggatatttttctcttatggtgcaaaatgacactatgagttggccagtctaggatttatgtgaag

SEQ ID NO: 22827 - DNA, 550 bp, Homo sapiens
  ENST00000477301
aggagacataaggtctctctgcatgcatacaccaaggaaaagccacatgaggacataaccaggaagagagccatcaccaagaacccgaacatgcggacaccctgatctcagacttccagccttcagaaccgttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctactatgcggcattcttctgattcatttttctccatttgtgctgtttttctctgtgatgtgaatccatccctatccattatgtcatgcctccatcttttgctgcttcttcagattgcactgagccataagaggaagcccctgtggtggccagagcagccttgttcctggaatgtgctcgttttgttcaccgctgcaaccgtggcaactggccagagtggatgaaagggcaccacgtgaacatcaccaag

SEQ ID NO: 22828 - DNA, 526 bp, Homo sapiens
  ENST00000481494
tttttatatttttagtagagatgagatttcaccgtattggccaggctggtctcaaactcctgacctcgtgatctgcccgcctcagcctcccaaagtgctgggattacagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccagatacctcctaaactcagccctttatgccttataactgtgaacagttcgcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgg

SEQ ID NO: 22829 - DNA, 2253 bp, Homo sapiens
  ENST00000333907
attcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagaggtaaacagctatggttatactgtactctgcatttgggggcaaagttagaaattctgaaaatacactcctgttattctacaaagacagaaagagaagcaagcaatggtaatgtttttagatagatcattccacaaaggatttgtcaactaggttcctgcaggcaacactttgcagttttctaagccaagctagtagaagggatcccaatttccaagtattgtctctccttaaaaattttccatagacacatggtcttctttctgttgtcaaatggcattcttgtatttcagatttatcattagctaagctaatgatgggtacttggcaagagtttggaccatctttatgtttttggtaaagtttaggcttctgatatattattagtattcagttgtaggtagtgacacttaaccaagcagaaaaggatctatgccactgagtgtgaccttgggcaggtcatttaaccgtaatccacagttctccctctgtaaaatgaagaggtttgctaaaatgatctttaagataacttctcatctatagttctatgattccatgacaaaacccctttaaatattttgtgtgttctctgtctcttaagaatataagtaaaaaaaaa

SEQ ID NO: 22830 - DNA, 2686 bp, Homo sapiens
  ENST00000477924
tcccgctggtcttctctagctgacctaagcaattctgtgaacagagaaacatcacattcccagagtcagaaaatcattatgaccaatggccattttggcatttggagggaggggacagcaagagtcagagaggcctggcgctccctctagaggccaatacctattaaaggttaaatgaactggaaatgatttagctctgtgcctggcacagatctggacacaatagatactaatgctaatgagaatggttcaaatactatgttaaacactggggatgtaaactaaggtcctggtcttcaagattatcacggttcaatgcaagaggcacataagaaaataactatgatacaaagttgttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcaca

SEQ ID NO: 22831 - DNA, 13562 bp, Homo sapiens
  ENST00000439458
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggtattccgagagaatgcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagtgaacctaatgtcctcgatgactcccagggcctggccgccgagggcagcctctctagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaagatg

SEQ ID NO: 22832 - DNA, 2048 bp, Homo sapiens
  ENST00000316333
tccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtctggttccaaaaccgccgggccaagtggaggaagaaggagaacacgaaaaagggcccggggcggccggcgcacaactcgcacccgaccacgtgcagcggcgagcccatggacccggaggagatcgcgcgcaaggagctggagaagatggagaagaagaagcgcaagcacgagaagaagctgctgaagagccagggccgccacttgcactcgcccggcggcctgtccctgcacagcgcgcccagctccgacagcgacagcggcggcggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggtcgccctgcggacaaggacgcggcctcgtgcgggccaggggccgctgtggcggcggtggagcgcggcgccgcggggctgcccaaggccagcccattcagcgtggagagcctcctgtccgactcgccgccgcgccggaaagccgcttccaacgccgccgccgccgccgccgcggggctggacttcgcgcccgggctgccgtgcgcgccgcggaccctgatcggcaagggccacttcctcctctaccccatcacgcagccgctcggcttcctggtgccgcaggccgcgctcaagggcggcgcgggcctggagccggcgcccaaggacgcgccgcccgcgcccgccgtgccgcccgcgccgcctgcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggcggccggacccagcccgccggagggcgaggagctggacatggactgaggccgcggcggccgggagaggcgcgtagccggcccgcggccgctcgctcaggctccgactcacgcaacgaatcaggtgatcggctctagaaacactgctttcccttcttttcttttgttttctttcttttattattttttttaagagtaaacgaaagtgctgtatgaattcggacccaggcagcaaccacaggactgggggtgagaccctcctcctcccaagagagcaaaaaggacccatggcccccaaaaaaccccacaacgagaatcctcagccttgtaaaatgcaaaaatgtctaagaatatttatatatgtaccatttttgataaataaagctggtc

SEQ ID NO: 22833 - DNA, 864 bp, Homo sapiens
  ENST00000416681
ggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtggg

SEQ ID NO: 22834 - DNA, 1932 bp, Homo sapiens
  ENST00000331803
gcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgca

SEQ ID NO: 22835 - DNA, 682 bp, Homo sapiens
  ENST00000432131
caggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaa

SEQ ID NO: 22836 - DNA, 1013 bp, Homo sapiens
  ENST00000457596
acagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagca

SEQ ID NO: 22837 - DNA, 974 bp, Homo sapiens
  ENST00000421046
agactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcg

SEQ ID NO: 22838 - DNA, 1375 bp, Homo sapiens
  ENST00000395564
tgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 22839 - DNA, 918 bp, Homo sapiens
  ENST00000436673
attcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggggcggtgacggaggctctggtgcaccttggctgtgagctgcagaggagcagagagcggcccggcgcggctgcgcggggaggcgggcgcgcggccgggaggttctggggctggtgtgtgcggagcgagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggt

SEQ ID NO: 22840 - DNA, 955 bp, Homo sapiens
  ENST00000395560
attcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 22841 - DNA, 869 bp, Homo sapiens
  ENST00000444999
cacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcagcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaag

SEQ ID NO: 22842 - DNA, 861 bp, Homo sapiens
  ENST00000482015
gcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatttgtgtgtgttggtggaagcccctcccggatgaaagccttcatcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 22843 - DNA, 782 bp, Homo sapiens
  ENST00000417464
ggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 22844 - DNA, 2782 bp, Homo sapiens
  ENST00000495446
tttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcc

SEQ ID NO: 22845 - DNA, 3515 bp, Homo sapiens
  ENST00000377107
gatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 22846 - DNA, 970 bp, Homo sapiens
  ENST00000478596
gttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggc

SEQ ID NO: 22847 - DNA, 3467 bp, Homo sapiens
  ENST00000469080
gagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatata

SEQ ID NO: 22848 - DNA, 804 bp, Homo sapiens
  ENST00000377080
aacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcgg

SEQ ID NO: 22849 - DNA, 1077 bp, Homo sapiens
  ENST00000377078
gtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatga

SEQ ID NO: 22850 - DNA, 516 bp, Homo sapiens
  ENST00000489111
gtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccctactctcctgctcctctctctcctcccttccccttctctcttg

SEQ ID NO: 22851 - DNA, 340 bp, Homo sapiens
  ENST00000489030
tgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgt

SEQ ID NO: 22852 - DNA, 697 bp, Homo sapiens
  ENST00000480104
cttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagat

SEQ ID NO: 22853 - DNA, 904 bp, Homo sapiens
  ENST00000488848
ctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatggtatttcctttggctatcagcgagggctggggaggctggaggggagatttcctggcagcaggatccatgaccacctctccctcacccccagcccagccgtacattgctatcgactgggagccagagatgaagaagcgttactatgacgaggtagaggctgaggtaaatgagatcccagggatggggggtacttccagctcttgcccctcaactcttcgtacatcctccccacaactcctctagctgggaacagagccaagagatccaggtcaagcttggccttggggcctgaacacctactgagagctccagggcctgaggttcctagcttcaaagtcggtgctctgacccactcagtgtgtgtctcccccgctgggcccccactccccatttctccatct

SEQ ID NO: 22854 - DNA, 900 bp, Homo sapiens
  ENST00000497179
acccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcg

SEQ ID NO: 22855 - DNA, 696 bp, Homo sapiens
  ENST00000467378
tcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacaga

SEQ ID NO: 22856 - DNA, 3338 bp, Homo sapiens
  ENST00000218348
ttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccc

SEQ ID NO: 22857 - DNA, 4669 bp, Homo sapiens
  ENST00000003302
agtcctgagaggctgggccggcggcggctgcggcgggagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttac

SEQ ID NO: 22858 - DNA, 3498 bp, Homo sapiens
  ENST00000544967
gtgcatttctaaccagctatcaggaagttgctgaatttaaaatgttgtctctgtggagccagaagataggctttagatagtcatagtgatgtcttttttaaaaagtctctctctttgcctaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtac

SEQ ID NO: 22859 - DNA, 3431 bp, Homo sapiens
  ENST00000545540
agtcctgagaggctgggccggcggcggctgcggcgggagaccggtgacccgcggctgggcgcctcggccatgactgcggagctgcagcaggacgacgcggccggcgcggcagacggccacggctcgaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaacta

SEQ ID NO: 22860 - DNA, 656 bp, Homo sapiens
  ENST00000544272
ctaattctaccttttatctgtaggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgcct

SEQ ID NO: 22861 - DNA, 3015 bp, Homo sapiens
  ENST00000540438
ctgagaggctgggccggcggcggctgcggcgggagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcaggatgcttcttcaggagttccaccgtgcaggcctgagagggttttcatttgaggagcatgttgggatgaggagttgtatattcatacaggagatatttttaaagaaaattaacttatgaaagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtctgcatctagcctgtttcaggacattgctcattcttcctacttgactgccagaggtgccattgcagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtac

SEQ ID NO: 22862 - DNA, 582 bp, Homo sapiens
  ENST00000538224
taactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgagcttaaagaagctgaacccaagaagcccatgccccaggaaacaaaccttgcagagcagtcagaacagcccccaaaggctaatgatgcagagtctactgcccagcctaattctgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaag

SEQ ID NO: 22863 - DNA, 1081 bp, Homo sapiens
  ENST00000538475
gcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatg

SEQ ID NO: 22864 - DNA, 1900 bp, Homo sapiens
  ENST00000537706
ggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtagaatgaaaattgatgggaaagtagtcaaggcatgtgctaatggtagatacaaaaatcaaatttgatagttttcttttaaacccaatgggaatccccctaagataaaagaataaacttaagatataaa

SEQ ID NO: 22865 - DNA, 733 bp, Homo sapiens
  ENST00000545608
gagaaatatcatgtttatgcaagagcttcagtatttgtttgctctaatgatgggatcaaatagaaaatttgtagacccgtctgcagccctggatctattaaagggagcattccgatcatctgaggaacagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtgcactgctcggtttctgaccagacatccaaggaaagtacagaaagctcttctcaggatgttgaaagtaccttttcttctcctgaagattctttacccaagtctaaaccactgacatcttctcggtcttccatggaaatgccttcacagc

SEQ ID NO: 22866 - DNA, 683 bp, Homo sapiens
  ENST00000535607
tgtttgctctaatgatgggatcaaatagaaaatttgtagacccgtctgcagccctggatctattaaagggagcattccgatcatctgaggaacagcagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattacc

SEQ ID NO: 22867 - DNA, 567 bp, Homo sapiens
  ENST00000537490
caatccagaattgtctccttttcctaaaagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcctacctgtacctgagtagggagaacccactgcctccatattttcggagggtaaaagtacagtgattaactcctatgcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtg

SEQ ID NO: 22868 - DNA, 732 bp, Homo sapiens
  ENST00000537642
tgcggagctgcagcaggacgacgcggccggcgcggcagacggccacggctcgaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcaggaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgat

SEQ ID NO: 22869 - DNA, 852 bp, Homo sapiens
  ENST00000542033
agaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcagtcccaggaacaaatctgaaaatccaatggtgcagctgttctatggtactttcctgact

SEQ ID NO: 22870 - DNA, 561 bp, Homo sapiens
  ENST00000540925
gggagaccggtgacccgcggctgggcgcctcggccatgactgcggagctgcagcaggacgacgcggccggcgcggcagacggccacggctcgattgaaatcaatataaggacttctgatctaagaatctggtgagagtgaaagaaccctggtttgagagaaaagctaatgtctgtatgaagaaacttgggaagagggcaatttgagcatgtcttctagtgttacttcggaatgttataacttaacaccacctcctcacccctcaagtactgcactttttcaagagaaaacgggaaatctgtgccagttgttcaaatacgagtttggagatgagaaactatatttgtcgtacaaagctggcagacagataccctcagagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggag

SEQ ID NO: 22871 - DNA, 542 bp, Homo sapiens
  ENST00000544750
agaccggtgacccgcggctgggcgcctcggccatgactgcggagctgcagcaggacgacgcggccggcgcggcagacggccacggctcgatttttaaggagggggaggagctgcgtgatgaatagaaagtctactgatgatgatctcctgttcccaatgtctaagaagattgaaatcaatataaggacttctgatctaagaatctggtgagagtgaaagaaccctggtttgagagaaaagctaatgtctgtatgaagaaacttgggaagagggcaatttgagcatgtcttctagtgttacttcggaatgttataacttaacaccacctcctcacccctcaagtactgcactttttcaagagaaaacgggaaatctgtgccagttgttcaaatacgagtttggagatgagaaactatatttgtcgtacaaagctggcagacagataccctcagagctgccaaatgctgttaaatcaactgagagaaatcacaggcattcaggacccttcctttctccatgaagctctgaaggccagtaatggt

SEQ ID NO: 22872 - DNA, 8032 bp, Homo sapiens
  ENST00000258399
gtgcgtgcgtgtttgcgtgtggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgatggggtttgttgttgtttttgagctggctgtatatattttaaaattataaatagataatatattattttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttc

SEQ ID NO: 22873 - DNA, 5019 bp, Homo sapiens
  ENST00000454775
atcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagaacctgccaggtaaaggtatatttttgctttttaatttagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacg

SEQ ID NO: 22874 - DNA, 4516 bp, Homo sapiens
  ENST00000415516
ggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatgaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccat

SEQ ID NO: 22875 - DNA, 3353 bp, Homo sapiens
  ENST00000418019
gcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaagttatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacag

SEQ ID NO: 22876 - DNA, 565 bp, Homo sapiens
  ENST00000473554
ttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggttctttgcccagtcctataacttcctaaaattaacaaagggacagctacaggaagagatcctgccagttttactgagataactaaagactgtgatgagaat

SEQ ID NO: 22877 - DNA, 293 bp, Homo sapiens
  ENST00000484018
gctccttggctttatgccttgattcagacagtgaggatgagctaaaacgttctgtggccctcagccagagactttgtgaaatgttaggcaacgaacagcagcaggaagacctggaaaaagtattctggtttcttctaaaagtaactctcttcttcaggattcaaaattatgcccaatagagcctgacaagtctgaattggaaaactcaggatttgacagaatgagcgaagaagagcttctagcagctgtcttggagataagtaagagagatgcttcaccatctctgagtcatg

SEQ ID NO: 22878 - DNA, 613 bp, Homo sapiens
  ENST00000475553
aaagataaatactctgcttttcttttagtcatttttaaactattcttgttattatcatagactttgaagattttcctatgtatttttacccccattttttaaggatttcttgtttcagtgttctctaggtaatggtattcaccccaacttttcatccttttaaagcagttgttcttagtgggctgtcacgagaagattgagttccattatgcgaaaggggtagcgttacacctaacagacaagaaattctacctaacctaaaggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatg

SEQ ID NO: 22879 - DNA, 593 bp, Homo sapiens
  ENST00000466523
aaagtagagtccccagaccagcagcatcaacgtgatctagtaacttgttagaaatggacatttttgtgccttctttttttggacacatttgtgtccaaacctactgaatcagaaaccttggggttagggtgtagtaatatgtagtttaacaagccctccagcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactc

SEQ ID NO: 22880 - DNA, 552 bp, Homo sapiens
  ENST00000486242
aaataaagtaaaatacctgaccattactcttcaaaattgtcaaagccattaaaaaaagaagaaattgaggattgtacgagtaaagaaacatgacaactacttgcactgtgggatcctgggccagaaaaaggactttagtgaaaatactgatgaaatttgaataatatgtgactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcag

SEQ ID NO: 22881 - DNA, 486 bp, Homo sapiens
  ENST00000478329
ttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgccccttt

SEQ ID NO: 22882 - DNA, 1771 bp, Homo sapiens
  ENST00000338465
catcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacagatttattgggtataaatacataagatacctgctaagcacttgttgagaacatgtgatcatgcagtgcagcacagaagggttgatggttttaaatgtaaaaagtgagggtaatggcaaatgcccatcaatgatagacaggataaagaaaatgtggcatatatataccatggaatactatgcagccataaaaatggatgagttcatgtcctttgcagagacatggatgaagctgaaaaccatcattctcagcaaactgacacaggaacataaaaccaaacaccacatattcttactcataagtggatgttgaacaatgagaacacatggacacagggaggggaacatcactcaccggggtctgtcgtggggtggggggctaggggagggatagcattaagagaaatacctaatgtagatgatgggttgatgggtgcagcaaaccatgatggcatgtgtatacctatgtaacaaacctgcacattgtacacatgtatcccagaacttaaaatataattaaaaaaaaaaagtga

SEQ ID NO: 22883 - DNA, 3222 bp, Homo sapiens
  ENST00000351842
gcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgc

SEQ ID NO: 22884 - DNA, 3126 bp, Homo sapiens
  ENST00000265560
cgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggc

SEQ ID NO: 22885 - DNA, 727 bp, Homo sapiens
  ENST00000483212
ttatgggttccctggttttggattattgcacatagccatcctgaagattggcactgaatagctctgttttttctattagtttcccaaaattatagtttaaaatcttggtccctgacagctccatttttagccttttgatcctttttgagaaggaacagattagaaaagaaggtgagttgttttttggttgttaagacacacactgtaaacttttttaatttcaggggttttgttttggggatttttgtgtttatttagtgcaagcctaataagctagccagattaattctctggagaccgctagagtattttctttgttgacttggcagacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaa

SEQ ID NO: 22886 - DNA, 3541 bp, Homo sapiens
  ENST00000485450
atgatttgtaaatcaaaccaggatgcttgaagatgaaccttgtggggttttttttgttgtttttttttaagagacagagtctcactctgtcacctaggctggagtgcagtggcacgatctcggctcactgcaacctccgcctcccggtttcacgcaattctcctgcccctcagcctccccagtagctgggactacaggcacatgctgccatgcctggctaatttctttattttctttttttttgagacagagtttcgttctttttgcccaggctggagtgcaatggcgcgatcttggctcactgcaacttctgcctcccgggttcaagcaattctcctgcctcagcttcccgagtagcgccatcacatctggctaatttttttttttttgagatggagtctcactctgtcaccaagctggagtgcggtggtgcagtctcggcttactcccgggttcaagtgatgcttctgccccagcctcccgagtggctgggatgacaggcgcccgccaccatgtccagataatttttgtatttttagtagagatgtggtttcactgtgtcttgaactcctgacctcatggccaggctggtcttgaattcctgaccttgtgatcgtgacctcatgatccgccagcctcggcctcccaaagtgctgggattacaagggtgagccacctcacccagcctaattttgtatttttagtagtgacggggtttctccatgttggtcaggctggtctcaaactcctgacctcaggtgatccgtctgcctcggcctcccaaagtgctgagattacaggcatgagccaccacgcgcgacctggctaatttcttttgcattttagtagagacagggtttcactgtgttgcccaggctggtctcgaactcctgagctcaggcaatctgcctgcctcagcctcccaaagtactaggattacaggcacgagccactgcgcctggtcagccttgtggtttttcacactgaaagggtatgtggtggtgtggactgatgtgacaggaagaccagttaatttgtggactctcacttaaataaagtttaccttgaagtagtatgaatacaggctttttgtaatttattttaacttaatatgaagaatatttattccttgagaagcaacctaaggcattaaatagggcttgctctttgcaaaaagtcagtagcattgtttctgcttctctctcccagatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaa

SEQ ID NO: 22887 - DNA, 2141 bp, Homo sapiens
  ENST00000431357
tccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttat

SEQ ID NO: 22888 - DNA, 536 bp, Homo sapiens
  ENST00000475873
ggctggaatgcagtggcacgatctcggctcactgcaccctctacctcccaggttcaagtgattctgctgcctcagcctcccaagtagctgggattacagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaaga

SEQ ID NO: 22889 - DNA, 749 bp, Homo sapiens
  ENST00000486549
aggagatggcggaaggtggaggctgccgtgagcgaccggatgcggagactcagaagtccgagcttggacccttaatgaggaccacactccaacgcggggcgcagtgatcctgagagtcagaccttgaaagaacacttaattgatgaattggactatgtattggtccctaccgaggcgtggaataaactactaaactggtacggctgtgtagaaggccagcaacccatcgtcagaaaatgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcgtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgt

SEQ ID NO: 22890 - DNA, 1155 bp, Homo sapiens
  ENST00000488520
ccacgcccggctaattttttgtatttttagtagagatgggatttcaccacgttggccaggctggtctcgaactcctggcctcaggtgatccacccgccttggcgtcccagagtgctgggattacaggcgtgagccaccacacctggccggttgtttatatttaattgtctttttttcactaatgaggaccaccttgtaaattctgggcattttcagagttttctcttccatgtgaattgctccagctaacttaatattagtttctcaagggtttgtgtagacctggctttgtctctttccatctgtttctctctttccctttaacgtcacttgcctgaggtctataaggccctttaaggttgccagcccagagccagaagagattggtgtccctgaagttaagaaagccacctttgcctacagatggtgttcacagtgttggtgtggagtcacagcttgacttttgatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcc

SEQ ID NO: 22891 - DNA, 544 bp, Homo sapiens
  ENST00000461553
atatttgaaacaatggaggaggattcactttcttctttggctgagcgcagtggctcatgtatgtaatcccagccctttgggaggctgaggcaggagggttgcttgagtccaggagtttgagaccagcctgggcaacataaggagactgttgctatggattaccaaaaaaaaaagatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctat

SEQ ID NO: 22892 - DNA, 1536 bp, Homo sapiens
  ENST00000416417
gccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaagtttcgttctttttgcccaggctggagtgcaatggcgcgatcttggctcactgcaacttctgcctcccgggttcaagcaattctcctgcctcagcttcccgagtagcgccatcacatctggctaatttttttttttttgagatggagtctcactctgtcaccaagctggagtgcggtggtgcagtctcggcttactcccgggttcaagtgatgcttctgccccagcctcccgagtggctgggatgacaggcgcccgccaccatgtccagataatttttgtatttttagtagagatgtggtttcactgtgtcttgaactcctgacctcatggccaggctggtcttgaattcctgaccttgtgatcgtgacctcatgatccgccagcctcggcctcccaaagtgctgggattacaagggtgagccacctcacccagcctaattttgtatttttagtagtgacggggtttctccatgttggtcaggctggtctcaaactcctgacctcaggtgatccgtctgcctcggcctcccaaagtgctgagattacaggcatgagccaccacgcgcgacctggctaatttcttttgcattttagtagagacagggtttcactgtgttgcccaggctggtctcgaactcctgagctcaggcaatctgcctgcctcagcctcccaaagtactaggattacaggcacgagccactgcgcctggtcagccttgtggtttttcacactgaaagggtatgtggtggtgtggactgatgtgacaggaagaccagttaatttgtggactctcacttaaataaagtttaccttgaagtagtatgaa

SEQ ID NO: 22893 - DNA, 1454 bp, Homo sapiens
  ENST00000415188
gccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaggggccccaggagatgttgacccagcagggcatggcgctgcagaactacgacaacaagctggtcaaatgcatagaggagctatgccagaagcaggaggagctgtgctggcagatccagcaggaggaggacaagaaacagcggctgcagaatgaggtgaggcagctgacagagaagctggcctgcgtcaacgagaagctggcccgcgtcaacgagaacctggcacgcaagattgcctcttgcagtaagttctaccagaccatcgcggagacggaggccacctacctcaagatgctggagagctcccagactttgctcagtgtcctgaagagggaagctgggaacctgaccaaggctacagcctcagaccagaaaagtagtggtggcagggacagctgaccagaccatgggcagggcctgcctctgtgcgcccctcaactcagccccagcaagtctgtccacagagcgtcttcttcatggcagcagctgccttctttcactgtctcaggtgctaagaggggcagctgccaacctccactggcatcagtgacaagcccggggcacagcctgtgggtcctggctttgtgctcacacaggctatggggagggtgggctctaggtcagctctgcaaggggcctgtctctgcggcacccacactcctgggctgccagggaggtcctggttgtagtctgagcaccatggaggtcccctcagccagcagaggcccagggcagggggcaggggttct

SEQ ID NO: 22894 - DNA, 709 bp, Homo sapiens
  ENST00000462673
ggattacaggcgtgagccaccacacctggccggttgtttatatttaattgtctttttttcactaatgaggaccaccttgtaaattctgggcattttcagagttttctcttccatgtgaattgctccagctaacttaatattagtttctcaagggtttgtgtagacctggctttgtctctttccatctgtttctctctttccctttaacgtcacttgcctgaggtctataaggccctttaaggttgccagcccagagccagaagagattggtgtccctgaagttaagaaagccacctttgcctacagatggtgttcacagtgttggtgtggagtcacagcttgacttttgggggccccaggagatgttgacccagcagggcatggcgctgcagaactacgacaacaagctggtcaaatgcatagaggagctatgccagaagcaggaggagctgtgctggcagatccagcaggaggaggacaagaaacagcggctgcagaatgaggtgaggcagctgacagagaagctggcctgcgtcaacgagaagctggcccgcgtcaacgagaacctggcacgcaagattgcctcttgcagtaagttctaccagaccatcgcggagacggaggccacctacctcaagatgctggagagctcccagactttgctcagtgtcctgaagagggaagctgggaacctgaccaaggctacagc

SEQ ID NO: 22895 - DNA, 601 bp, Homo sapiens
  ENST00000464168
gggccggctgggccggggccgcggaggagatggcggaaggtggaggctgccgtgagcgaccggatgcggagactcagaagtccgagcttggacccttaatgaggaccacactccaacgcggggcgcagtgatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaagtaag

SEQ ID NO: 22896 - DNA, 821 bp, Homo sapiens
  ENST00000491791
agctcagtatgaagagctgacggaattctgcggtgggccaggtggctctggcgtcgactgtttaaggcgactgttaatgactacaacacaccattgagtcttggtcccaaggcgctggtgcacatggtacttcccgaaatccctgtagggccgctggagcaggagccccgatcccacgtttgggcagctgactcgcctaaggcctccagctgaaagcggaattgcaggggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtca

SEQ ID NO: 22897 - DNA, 3624 bp, Homo sapiens
  ENST00000570827
aaaccgcgtagggggcgcgcctgagagcctgaaaacttcctggttagcaaatactgaggctggaaagggcctgaacttggcagtccatagatccaggtcgagttccggtttccctgcttacggatcgggcggcctccctacgttgcgataacctctctgagcccccttccttgccgattaaagcaagggtgatcaagtcttgcaagtttttggaaaatgattctaacccaatctgtggtgtaaaaaagcaaaccacaaccactcgggggcttttttcacagggcaacacgtggctcccagttcaggtcccgggttggcgggtgcaggcacagactctgcctccccccaaggggcagacggtctggaaggaggtggcgacacctgtccgcacacacctgagcctgcggaggaaccagcggtgcacaaaagcgctccccacccccacacagcgcccagcgcgcgcctctcaccacgcccgaggctgtgctctggagatgcctgccttgcccttttcttcctgcagtagccaggcctttaccatttactaggcgctttcagaatgttcatttctccgtaatttccactgcttgaaggctgctcgaggaacaggagcagcggcgaaacccaggtctgtcggtttacgagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctct

SEQ ID NO: 22898 - DNA, 3500 bp, Homo sapiens
  ENST00000570475
cggcaccaggagccttagagaagctgtagggcctgctggccgctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgcc

SEQ ID NO: 22899 - DNA, 4169 bp, Homo sapiens
  ENST00000285199
cggcaccaggagccttagagaagctgtagggcctgctggccgctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatgaaacacg

SEQ ID NO: 22900 - DNA, 3425 bp, Homo sapiens
  ENST00000574408
ggcaattcccagcacgacgccctggaattcctgctctggttgctggatcgtgtacatgaggacctggagggttcatcccgagggccggtgtcggagaagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 22901 - DNA, 711 bp, Homo sapiens
  ENST00000575346
ttcttttcggagctgaaaacagagtgacaaggagtctgccattttaataactgggcacagagtattccaggcagaggacacagcacaggcaaagggccagaagtgggaataatcctggcaagttcaaggaatggaaagcccaagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctat

SEQ ID NO: 22902 - DNA, 2641 bp, Homo sapiens
  ENST00000573955
gcagcctgttcgggagcctccaggaggagcgagcgcaggatgccgacagtgtgtggcagcagcagcaggcgcatcagcagcacagctgtaccttggatgaatgttttcagttctacaccaaggaggagcaggtcccgccctgggggtccatgccccggccgggaagggggctggctgcctttggtgggttggccacgtgctgcgggggcctcacagtccgggtggtttgctttccagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 22903 - DNA, 10036 bp, Homo sapiens
  ENST00000338981
tgaataattgaactttgtttatttctccatatttttgcagtggtaattccattataaaacctaatgaaacaatgtttttatagatggtgtggaaagacttttctgggctcagaggtgaaactgacccttgtgtatcagcagcatttctgactgactgagagagtgtagtgattaacagagttgtgatgttagttaagaaacttagatttgccattgtagcttttctaccaattagcagattgtttaactcactgaaattgtaaagtggtagacgtggacttagtcattactgggcagcttatgaattgtattcatttactcatgatgtaaaaatggttagtctccacttttaaggctctagttctagtggctaaataggtacttatttatacagtatgataactgctgtattaaaatacatgtctcaaatgtggaatagtagaagaggtgaagaaaatcatagtttgaggtagaatactgtttgctggtcttaaaaactgtggtattttggtgattccataaattaggtcagatacttccactggagggaaacagtttaaaggatatatgtgatactattaatagaatgaggaagacacaccagatatttaggagggaattagcgagcttgaaactaagagctggtttgaatgagactgggtcataagtgatttcaagtaccagattaaggcactgagattttatttttaagcactgaagtcagattttttccttttaaaagaaaggattcatgatgaaatctgctttttgttttgcagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagatgaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattctacctatgtcgagagcatttcgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaacttggagaaggcaaacttagtccaccccttgactctcttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactagtttttagcccaaatgaagaaataactaaaatttatcagatgaccaccaatggaagcaataagctggaggtggaagatgaacaagtttgctgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccaaggctgcccacataggtatgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacttttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaataccttctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaaga

SEQ ID NO: 22904 - DNA, 787 bp, Homo sapiens
  ENST00000493168
ggagtatgtgttggaggataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggtgcatttgtttggatttgttttattaatggatgcagtaaactagaaaagcaaaactacttccagcattgcaactagtagtaaatgagaaaaagaaaagagtagattgtagtgtctcaagtcttactattttaatagcctgaacattttagtcctagctgaacactttgcagctcattgtacttaatgcaggcatttcttatggattttaaatattggaaggtaatgacaatatgaatacagtttcagattaatgatgctttatgaacccttcctgtgtttctagcctagacaaataggtaggtattttgttttgaatgtttacaaacatttctctttgataagaactttataccagagttctggagaacttttctcacttgtggaatgtccatttgctacagcagagaccttattgcagaaggttgtattgcttctttctctgttttgtttagcggttgctgatt

SEQ ID NO: 22905 - DNA, 9118 bp, Homo sapiens
  ENST00000426564
gctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagatgaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattctacctatgtcgagagcatttcgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaacttggagaaggcaaacttagtccaccccttgactctcttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactagtttttagcccaaatgaagaaataactaaaatttatcagatgaccaccaatggaagcaataagctggaggtggaagatgaacaagtttgctgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccaaggctgcccacataggtatgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacttttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactgatgtttctgttttaggtatgatgcactgtgcgttcttctccgtcacagcaaaaatgtacgtttttggtttactcataatgtcctttttaatgtatcaaatcgcttctctgaataccttctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaaga

SEQ ID NO: 22906 - DNA, 909 bp, Homo sapiens
  ENST00000453031
aattattgaagactgcagtaactcagaggataccatcaaattacttcgcttttgctcttgggagaatcctcagttctcatctactgtcctcagcgaacttctctggcagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacaga

SEQ ID NO: 22907 - DNA, 2410 bp, Homo sapiens
  ENST00000471409
cttgcaaaagcttgtgaactctgtccagaagaggtaaaaaaaaaaaaggctaccaatggacagcagatggaaatgggaaaaagaaaagtatttttttaatgtgtaggcccatgtttattaatattgtgcttaaaaaaatcatgtgcagttttgtttgctttagtggttagcttgatttgtttgatcttaagttaacaaaggagtttccttttggaaaaaatttctgtgaaattgtctaaaaatcacatacctgagagaattcagatattcttttgtttgttttttgtctttgtttgcttttgctttttctttttttttttgagtctcaccctattgcccaggctgctgcagcagcgtgatctcggctcactgcaacccccacctctcaggttcaagaaattcttctgcctcagcctcccgagtagctgggattacaggcagccaccaccatgcctggctaatttttgtatttttaatagagacaggatttcaccatgttggccaggctggtctcaaatcttgaccttaagtgatccacctgcctggcctcccaaagtgctgagattataagcatgagccactgcacccggcctgttttcttatattttaaattatttgcagtaaatgcaaagatgttaaagaggccagctttgtgcattttttaaaagtttattctaaatgaaggaaattaaatataaatttgaagttacttttataatctaatgcttaatctctttaaatatttaaaattaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaaga

SEQ ID NO: 22908 - DNA, 1133 bp, Homo sapiens
  ENST00000465952
cccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaag

SEQ ID NO: 22909 - DNA, 3814 bp, Homo sapiens
  ENST00000255304
agggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgt

SEQ ID NO: 22910 - DNA, 4074 bp, Homo sapiens
  ENST00000614860
gcgagtgggggaggagcagtccgaggggaacgtgggttgaacgttgcaactagggtggagatcaagctggaacaggagttccgatcgacccggtaccaagaaggggagtgcccgcggcagaattttgattcagctaaagttccatcagatgagtattgccctgcttgtagagagaagggaaagttaaaagccttaaagacttaccgaattagttttcaagaatctatctttttgtgtgaggatctgcagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctggaaacctgttgctcgtggcgctttgcccacggtgcccgagttcttgtcctgtgtccagatatgcagacaaatgaagggtgaagaagaagaagaggagctttatttagtgttagaacagctcagaaggagacccacagtgagcagctcccctgtgtcggcgggcaggtcgtccctcaagtgttcagctctcagcagagaaaaggccctggagagggtgactcctctcagctctcagcagagaagcagccctggagaaggtagcttctgttcgcaggcagattgtccagaggtcctgctgctctcagacggggccctggagaggatagcttctatccataggcaggttgttctgccgtctctacaggtctctgaagctcttagcagagagggtagctcctccctgttgctggtcgtcccaccctctgctcagttctggctgagcctggggcattttacgggcctcgggggaggaagtgcatacttactggcctggaaaaggcaccagttcccactcctacaggtgggactggcagcctggccctcagccttcaggccctccctgttcatggcttccaggcttacccccctgctttgatctgagagctggtgccaatagcagggagaagccaagctgcagaggcaagcacttccgagcctgcaaaagcaggcccccaaaagtgcagggatgcctgagtctgcacccgcacccaggagggtggagatcttgcctgctccaaggctgcagccggaatgatagcaggctgactggagcacctgccaccatcattagttcaagagtttatgcagatttaagttgtatacggtatatgaatgtgtgacagttttccttatggttgtgtggccttctgtaagagcctacgcctgtttgttacaccggtagagtgctgtggaatgtaaactttccctatgtcacttatctcctttatctctccatacagaggagggcaagaaaccttgttacttgaactttagtaatgttaagtgatcaataaatctataaataaatgatagcagaaaaaagtta

SEQ ID NO: 22911 - DNA, 6529 bp, Homo sapiens
  ENST00000331397
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22912 - DNA, 3636 bp, Homo sapiens
  ENST00000624098
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggctctttcattatcatcctcatcttga

SEQ ID NO: 22913 - DNA, 4990 bp, Homo sapiens
  ENST00000362096
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtaagtgccttctgaaactgctgcagtttctctttgggggtattggtagccattcagtatttttttcaaaagaattctgttgacattaaatgatatcagcagtccagaagtcttggcaaaatgtaataagatgtaaataatcttatatattcataagtgttataaaatctcataagattaaaatattgccttcccttacagatagtcacttgtgtttattacaatttagagaggaataaagatgtacatgaatatacactggtaaa

SEQ ID NO: 22914 - DNA, 4325 bp, Homo sapiens
  ENST00000329134
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattgctaatggagaaataaagttcctactttacatcta

SEQ ID NO: 22915 - DNA, 747 bp, Homo sapiens
  ENST00000478900
aagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaaaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatat

SEQ ID NO: 22916 - DNA, 1387 bp, Homo sapiens
  ENST00000474365
tccatcacccgcctggttggctggcgatactctccgggaaggcctggacgcagcttgcccacgttgatgacggggtcatcctcagcttggcactcaccaatctgtcgctgtcgctcttggactcgggaaggagcaagtcactggctttctcagaccattaacaagctctgtgtctctctctctacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccaggtaagtgttttaacttaagaacaagaatgaaacagtcacctatgctttagatgaaatgaaatgtacttgaaaatatcaggctttaaatgaaataaatatattagacgatttgagttgtgggtattatactcttgcatgtattttgtattctactcctcattaaatgtgtttgaaatttttagtgaacaaattgttaaagacaaatgaaggcatttgagatttgtacttaatatatatatatatagcagtttgtgtaactaccttaaactgtgtattttatttcctaaatacaatacttgctatgtatgcagtgctttgacttaatgtaatttgcctctatacctttatttagaagctttcatgtaaccctgcatgtaatgtctacttttcttttaaaattttcatgaatgattgtaataagtcactgttattgaagttttctgtttttctttaagactgaggtatcttttaagcatcataccatttcaaatgatagttaccattagttcaaggctgtttgtttttaaagttatttcagctttttaaaaaaatattttgctttgtatagcagattttattataatatttaaactgtaacatacagatttacagtttgtggtggagttggtagacttaaaaaaatgggtagcattttttcatattatgagtagctgaacattttgaatttaaattgtgaaataaagaga

SEQ ID NO: 22917 - DNA, 1539 bp, Homo sapiens
  ENST00000382893
gcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaagtaagtatttttaaatgaaatacttttgagtaaagaatattaatgatacctttttttctactgatacctttgtttctgttcattcttgagaagagaagtgagaaggcatgtgcctgattcagagagtttaaatcactggagttgagttgatttgggtactatttttcttgctcaaagacagtcagtattattatttgataactgtagaaatgattggtatgtcacagagcactaacaaatagtgattacctactttagtagtttttctccctttatggtgtctatgttttcatattaatgaattacttcaccttttaatattttaggatttgcacataccgtaagcttgactattttttgaaacttttttgtgtacttggtgatgttgcaaaaatcaaaagttttcaaagccaattttaaacaaaacctgaataagttaaaaatgtgtagtttaaaaaataaatactgttttttgaactctttcagatgaatgactacagttaatattttgggaaaaaaacatgtttaaaaagaatatgaaactttaaattatgtgattttcctttgtgataaaaatgttagaatattaaagaccttttatgtcaattttttacct

SEQ ID NO: 22918 - DNA, 686 bp, Homo sapiens
  ENST00000479713
gtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggtaaaagcaaccagacgcaaagtctttggtccgcactttgctctaccaaggccccgcgttccttaccgcccagccagtatttattttggctctgctccatggccaaggggtcggaaaagtgtttcttgcctttgctgtccccgtactctggaatacttcgccccttgctccagactcccttctactctgaggaaaaaaaaaatcggacgctt

SEQ ID NO: 22919 - DNA, 6574 bp, Homo sapiens
  ENST00000538878
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggcctaccttggacatcttacaggtttcatacaagacaactgcaataaagggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22920 - DNA, 6652 bp, Homo sapiens
  ENST00000540140
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaagtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22921 - DNA, 6661 bp, Homo sapiens
  ENST00000382896
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22922 - DNA, 6490 bp, Homo sapiens
  ENST00000537580
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22923 - DNA, 6817 bp, Homo sapiens
  ENST00000545955
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcaggcttatagagctcatgatccaaatactgaacatgtattaaaccacagtcaaacaccaattttacagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22924 - DNA, 6682 bp, Homo sapiens
  ENST00000617789
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggcttatagagctcatgatccaaatactgaacatgtattaaaccacagtcaaacaccaattttacagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22925 - DNA, 6277 bp, Homo sapiens
  ENST00000618474
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22926 - DNA, 6586 bp, Homo sapiens
  ENST00000612274
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 22927 - DNA, 2420 bp, Homo sapiens
  ENST00000374115
ggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgcgtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccgcggcgcctccgcccaaatcaataaactgtgtctgtcccagga

SEQ ID NO: 22928 - DNA, 1068 bp, Homo sapiens
  ENST00000400911
gcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 22929 - DNA, 3449 bp, Homo sapiens
  ENST00000361716
accacaaatgcctaacaaactgctgaagcgccctccgaagggacagacctcatctccaccccgccccgtccctccgccagactggagcgcaaactatggtcgcattgatcactgaaggatcctcacagcaaccgctcctttccggagtcggatgagaggagagttgtgactggcaattggcaggggcggggcgggctaggcctgtagcgctgggcgaccgtcctgggcatggattgggccgcggggttgtcaccgttatccgggaggcgtggtcagcactaataaaggcggaggccggcgcggcagctgcagtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 22930 - DNA, 759 bp, Homo sapiens
  ENST00000544432
ccacttcagccgcagcgtccctcaccgggtgtctcgccgcagcctccggagaggaacagaccctcactctctctgtcagaaaaatgtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcac

SEQ ID NO: 22931 - DNA, 747 bp, Homo sapiens
  ENST00000535180
gtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctc

SEQ ID NO: 22932 - DNA, 1113 bp, Homo sapiens
  ENST00000396308
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtcttt

SEQ ID NO: 22933 - DNA, 567 bp, Homo sapiens
  ENST00000538970
atgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggaga

SEQ ID NO: 22934 - DNA, 578 bp, Homo sapiens
  ENST00000535927
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcg

SEQ ID NO: 22935 - DNA, 565 bp, Homo sapiens
  ENST00000539047
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagctttctcagattgaaatatatatttttaaataactgcaacttttgagaatgagctgaacacttcacagtgaaaattgaactaattggttaaatatccagagtctgtatctctattggaatgccttctaaag

SEQ ID NO: 22936 - DNA, 3825 bp, Homo sapiens
  ENST00000302536
gtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatacttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgatagaagtgaactgaaacattgtctaatgtctttgtggctttagagcttttgttatattgtgcctataaagcaaattatgtttacataaaaatataaataaagtattcagcatagcaaaacctca

SEQ ID NO: 22937 - DNA, 615 bp, Homo sapiens
  ENST00000563850
ggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcaaggcctgctcaaacactgagggtcatttggaagaaaactgaagagagggcctacgaagaggtggaactttgctctgaaaagtcctagaaaaaaaatttttcaatgtattcaagaagggcttagaaattaaaggtcgactggaattatacaggaatttcccactcagctatcttaatgatgttgcatcttaaaatcgctgcagtttgtgcctcactatttgtcaaacatgctattttctttcacaccataacgatgatgatactaatagaagaagttaacatttacagagcaatctgactccaaatttggagc

SEQ ID NO: 22938 - DNA, 4691 bp, Homo sapiens
  ENST00000406606
gccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 22939 - DNA, 4837 bp, Homo sapiens
  ENST00000371850
actgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtctcacgggaaaatgtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 22940 - DNA, 5101 bp, Homo sapiens
  ENST00000371851
cgcggattggggagcgctgcggcgactggctgcgtggagcccggcccggggcccgcaggcacttgcgtgtgtgaagcggggagatccggcgcgctgcccgttgcccgccccgcggccgcacgtgggcgggagcggcggcccgagaggagcccgaggagtaggaggaggaagaggaggggacgcacggcggcgcagcgggggacctggggcagcccgcgcgaagccccgccccggccctgagccccgcgcgcgcgcgggcgggatgccccgcggccgctgcactttggctcgagcactgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 22941 - DNA, 523 bp, Homo sapiens
  ENST00000486113
gcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggtgagctctccggagtgcgctgccaaggccgggtcctttcatctccatcgacaccagcgtgccttgtcacagatactggggttggaagcagatgccctctgcctgtgtctttatcatgcatttgcagcgtgttgtcgcgtaacccgttggcggctgcaggaa

SEQ ID NO: 22942 - DNA, 506 bp, Homo sapiens
  ENST00000472905
gctgctgttgctgttacggtttttacagagcttacagttttaataagtttttccttgccctccctttgttttttccctttagtttctgtgtttgaagaacatacgcaccttcctgaaagtctgccacgataaatttggattaaggaacagcgagctgtttgacccctttgacctcttcgatgtgcgagactttggaaaggatcctaggaggctgtgatttcaagacctgagttcaagctctgggagcggccttggcccatgagtggatcccttgatctccatgccagtggtgtgaggacttggctctgggaagaggggcctctgggtggcagtggtggcagcagcccacgcttcaggacgcactaggagcagaggaggtgtgctcaggccctgccattgtttctcatttgcccccaagacattaattgtgtctgttggagcctgacaatttgatgtttgcagcaaaaaagccaaatgagaccaagaaggagaaaagaaaaaaaaat

SEQ ID NO: 22943 - DNA, 1147 bp, Homo sapiens
  ENST00000234392
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaagggaaa

SEQ ID NO: 22944 - DNA, 12625 bp, Homo sapiens
  ENST00000265077
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 22945 - DNA, 498 bp, Homo sapiens
  ENST00000503923
tgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaaggtgagtgtgctaacaa

SEQ ID NO: 22946 - DNA, 5923 bp, Homo sapiens
  ENST00000512590
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 22947 - DNA, 3973 bp, Homo sapiens
  ENST00000513960
tttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatc

SEQ ID NO: 22948 - DNA, 1825 bp, Homo sapiens
  ENST00000513984
ctccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaa

SEQ ID NO: 22949 - DNA, 2087 bp, Homo sapiens
  ENST00000502527
caccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcg

SEQ ID NO: 22950 - DNA, 536 bp, Homo sapiens
  ENST00000515397
ggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagca

SEQ ID NO: 22951 - DNA, 8483 bp, Homo sapiens
  ENST00000513016
ctgatgaaacagcaaaagctagatattgtttcttctatacatagaaggaaatagcttcttgcaacaggaacaattcaggagaaaacagttgttttctcccctttagatgataggttgggaagcagggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatactgctttgtcactgaaagtaaggcagctgcagtggcaggaccctgttctaggacagttgaatgcctctatgatgagacctcagaatttcctctttcctagtgcccaagacaaggagctttgctgatgtatttctgatagcagaaaaggccattgagcttagtggttggtaccatatggcaatttacaatctgggaaatattctgatgatacatacttttcgaggaatgctagttagaatatttagataggactcctgaactttctttgagaagatgttgatgacaagaactaaaatcagcctaatctgggtcacatcccaggaaggataaaggtctataggtgtggaaggctctttctggtcctttcagtgagctatttccaatagagcccgcctatccagagcttcccactcttgtgcataggatgtggttaagctcatgtctcagtgccacagtaggtagaggatgccattgcaatgtaaaagggctataaataaagctctcttgtttttccataaaacagtctgctctagaacagattataaaggggccagaaggaatctcttctcattttcttattgaatagagagtgtataaattattcccttacataaaggacaattactttttctatatagatcatatatagaaatagagctatagaaaaagtaattaattctatatgatatggcctcaatttttaatttttaaattgtttttatatgaaatagtcttaattttactctttttgcagttcacacaaagatgaattcctgcacttcaagattacattgtatatgtgattccttgcttcattttaaggactatgttgttttcttaaatgtgttgatgagtctttataacctgttttaataatgttaaattgaattcatttttcttattgttaatacaaaaacagtaaatttgaagactgagaaccatataagagggtgattgcacttattatgaaaagatttgaatccttctttgtgtgtgtgggtgtgaccagccttgctatcaatttcttctgtcatacactgccaaattttctatttaagtattgtgaaaactctgtttttttcaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaa

SEQ ID NO: 22952 - DNA, 766 bp, Homo sapiens
  ENST00000507162
ccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccagtttaaaggagtacatttggaacgtgtttttggaaaaagcatgttaatgtagcagaagagacttcagtgcacactttcgaagaaaaacagtttctgagcattaagtggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtg

SEQ ID NO: 22953 - DNA, 810 bp, Homo sapiens
  ENST00000505615
agataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcg

SEQ ID NO: 22954 - DNA, 7154 bp, Homo sapiens
  ENST00000342785
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 22955 - DNA, 9455 bp, Homo sapiens
  ENST00000343200
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 22956 - DNA, 3725 bp, Homo sapiens
  ENST00000273038
acatttcagagcagtccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 22957 - DNA, 1554 bp, Homo sapiens
  ENST00000413604
aattttaaccccaccacacatacaacagttaccactcttgtctaacatacaagtgttgggttaaggccatctagggaggggccccaaagatgcataaaggcacataactgaacggacctgtccctgaccttatgtgcggattcttttcctttgctgtaagccttgtgtgaggctgcacagtcttaggatgaggcgttgtctgattgcagaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactatt

SEQ ID NO: 22958 - DNA, 938 bp, Homo sapiens
  ENST00000451674
atccagttttgtgcctgagactgcttgccaagtttgtgaggcccaaggctttcttgtgggaggacgctgggctgtcttcatgctctttggcaatgattaaagtgaggaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactac

SEQ ID NO: 22959 - DNA, 1025 bp, Homo sapiens
  ENST00000424529
agtgcccgcctaggatggggatgaggcccggggcggggccgggtgccgtgcagcctcagcggctctgataggcctggcacggagccactcagagtcctttgggtgttcgcggggatgccgtgggctctctcgggcacagtcctgaccaggagcggaggcgacttccatctcccgggcaggatgcgtgcggttttctgccgtccccgggagcacatgacgcctgggaagcagtggccgggaggtgattcatccgggcgagcggggcctggaaaacaatgtctgtcttgaagctccgggaaccaggaaaatgagctggaaatgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgg

SEQ ID NO: 22960 - DNA, 1377 bp, Homo sapiens
  ENST00000430365
atgccaagcatagccctcatgtcagcgctgccggcttgcagcgggctgtgagaggggccggcgccgctttgtcctaggaaacgggctgcgcgtttctctttttcactcttttccatttccaggaaggacttgtaaggacttctgaaacgctgttttcatactcgatcggggatacagtacatacaccgtctaccagtaagcccttgaagggtttcgtgtgagctcgatttttttgtgcctgatttttttttttttaacttttgcatactttgttttgatagtctgaggctgggcctctgcctttgtgaagttgaagagccaggagctactcagcaacaattgatttttgaaacttaactcttttggggcaaaagcaaagagctggttttctttgctagcccaataaatgctatttatgaagatggacctgttgaactatcagtacttggacaagatgaacaacaatatcggcattctgtgctacgaaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaa

SEQ ID NO: 22961 - DNA, 1428 bp, Homo sapiens
  ENST00000426568
ggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaaccgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaa

SEQ ID NO: 22962 - DNA, 726 bp, Homo sapiens
  ENST00000445411
gggttgtggacgccaggagtttgccaaacacagcaaacactggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcc

SEQ ID NO: 22963 - DNA, 792 bp, Homo sapiens
  ENST00000418000
gcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcg

SEQ ID NO: 22964 - DNA, 766 bp, Homo sapiens
  ENST00000458499
ggggtttcaccatgttggccaggctggtctcgaactcctgaccttagatgatccaactgcctcggcctcccaaagtgctgggattacagatgtaatgaaatctccagctctgccagatcttttgtgtcatgagaaaaaaccaaaacaacttagttcctgcccatccagggcttatctttgaagtaataagaggagaatgaaagacttgaagaaaagagtggcacttggatacatttccacccacacaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagc

SEQ ID NO: 22965 - DNA, 581 bp, Homo sapiens
  ENST00000417206
agggattcctcgcgctcccgcgctcccgtccgccggcccggtccgcgcgtgcgtgtgcgtgctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtgggg

SEQ ID NO: 22966 - DNA, 894 bp, Homo sapiens
  ENST00000417466
gcgctcccgtccgccggcccggtccgcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacggtcttgctctgttgcccagactggagtatagtggcacaatcttggctcactgcaagctccgccccctggggctcaagtgatcctcccacctcagcctctcgagtagctgggaccacagcgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgcc

SEQ ID NO: 22967 - DNA, 437 bp, Homo sapiens
  ENST00000424709
gcactttcctagtttactcagaggcctctgaggctacctgagagccagagtctagggaatggaggaccaagaatagaaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctgga

SEQ ID NO: 22968 - DNA, 466 bp, Homo sapiens
  ENST00000419541
ggcaggaacacctggcagtttgaatgtgattcctccgatgctcacccccctggcctccacatctagacaaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttg

SEQ ID NO: 22969 - DNA, 544 bp, Homo sapiens
  ENST00000437722
atagtatgagaggtgctttgtgttgccacccaagggctgggggattgcaggcgatccttgcgcttgggcagacagcacgtcacggcttttatctgccggctcgcattgcaatgggcgtcctataaaaaaagaaaaaagtgagccagaatggggctagccacaagttgaacaatttgaaggagattgacttcacggtgtcttctccccagctgctcgaccgtgagacaaagaagtattatttgaaagaaagcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacct

SEQ ID NO: 22970 - DNA, 728 bp, Homo sapiens
  ENST00000623028
ggcctttctaaaacgcccagcccgtccctggaggccacaggttattgcctgtgttctcttctcttttgatagccagccaagaagagggaacgcagggtgactcaccaggtgcccacctggactggatttaagtcagaagagaaggaagatgtgagtattcattaaacgtctctgcgaagcctgtaaccccacaccggctcttcgaagggctaagatccagtgagacaccgtgctgttccttgatatgatcagatgaggcaacagatgggaaaacagtttgaaaactgcaaagcattttttttttccagcacgaatgacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagc

SEQ ID NO: 22971 - DNA, 586 bp, Homo sapiens
  ENST00000480288
tttgagacggtgtcttgctctgtcgccaggctggagtgcagtggtgcgatctcggctcactgcaacctccgccttccaggttcaagcgattcttctgcctcagcctcctgagtagctgggactacaggtgcgtgccaccacacccagctaatttttttgtatttttagtagagacggggtttcacagtgttggccaggatggtcttgatctcttgacctcgtgatcttgcccgccttggcctcccaaagtgctgggattacaggtgtgagccaccgctcctggccctcctctgccttcttggagggattaggtgtttgtattttcatggcatgctgtgcatacttctgccatggaatttatctcgctgtgttacctccctcctctgtctggcttactctaatttctgggagggctaggattttgtcttgcagctactcgttcttcacaccaggcaagtgttgtctccttatgaatgactccagtgtcttttgactaaagataagcattgaaattgcctgactagcccaaggatactcagcgagttggtgatacaagcgaagctgctctcaggggagaacccagaat

SEQ ID NO: 22972 - DNA, 238 bp, Homo sapiens
  ENST00000463387
cgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacagatggggtttcatcatgttgcccaggctggtctcaaactcctggcctccagcagtccatccgccttggcctcccaaactgctgtgattacagg

SEQ ID NO: 22973 - DNA, 453 bp, Homo sapiens
  ENST00000414047
ctatgggggcaaaagctaaaaggggtaatagagatagcaataagggagccaaagctgtgaggaaagtccttggcagagagatgagaaagaactagattggggaggacgcacaaagaaacagagcgaaagggaaactgagaagctgtgcagtcgatgggtgcccacctggactggatttaagtcagaagagaaggaagatgtgagtattcattaaacgtctctgcgaagcctgtaaccccacaccggctcttcgaagaagcattatctctgttttacggatgagaaaactgaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcgg

SEQ ID NO: 22974 - DNA, 93 bp, Homo sapiens
  ENST00000638314
atggagacgccattggatgttttgtccagggcagcatctctggtgcatgctgatgacgaaaaacgatcatgctgtgttgcccaggctggtttc

SEQ ID NO: 22975 - DNA, 2135 bp, Homo sapiens
  ENST00000544301
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaact

SEQ ID NO: 22976 - DNA, 757 bp, Homo sapiens
  ENST00000478746
gcagggcgcggtgagtcaccgccggtgactaagcgaccccacccctctccctcgggctttcctctgccaccgccgtctcgcaactcccgccgtccgaagctggactgagcccgttaggtccctcgacagaacctcccctccccccaacatctctccgccaagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctct

SEQ ID NO: 22977 - DNA, 634 bp, Homo sapiens
  ENST00000497849
cgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccaggtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagc

SEQ ID NO: 22978 - DNA, 1868 bp, Homo sapiens
  ENST00000224237
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 22979 - DNA, 2272 bp, Homo sapiens
  ENST00000487938
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 22980 - DNA, 1139 bp, Homo sapiens
  ENST00000485947
gctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggtttgtagactctcttcccactcgcagccgcctgaccccacccaacacaacccacgagcaattctaaaagttgcttaactcacgtctaaaaagtgcaaaacttcagggctgcgcgtaaagccctctagtggcgggaagaccacaggttggagcttctcatgattagaaaaatattaataaaaccccttgagcgattttttttttttttttgagacggagtcttactctgtcgcccaggctggagtgcagtggcgagatcttggctcactgcatcctccgcctcccgggttcaagcgatccttgaatgatttctaagcagttccttgggacataaagaaaaatcttttaactttttactttgtttcccaaatgttgcacagttt

SEQ ID NO: 22981 - DNA, 2666 bp, Homo sapiens
  ENST00000469543
aagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 22982 - DNA, 753 bp, Homo sapiens
  ENST00000421459
ggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaatt

SEQ ID NO: 22983 - DNA, 508 bp, Homo sapiens
  ENST00000637053
caggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaaggtaggaaacaaatcagtgcggcttcaaccaaagaaaagcattgtgttctcaaaaccccatacctgtgtgtgattcctaaatatcctctagctccaatgcaaagctggctttgacttcttgctcatattgtgtttgccaccacagcctccccaccactcacatcacctcctttatttatttatttattttctta

SEQ ID NO: 22984 - DNA, 962 bp, Homo sapiens
  ENST00000495528
ggcataagccaccatgaccagccttaaaaagtaattttaaaatatcactggtaaaatgtggattcagtcatgattgagtgcagtttaccatgtgtgtggacatttatttattttaaaattgtctgatcaccaccttgagtaaaacacaagcagtcacaattaaaatatattagtgagcaggagaaagcacagcatattatagcactgaatgatttataaacctattccagggtcataaaatgtgtcaacggcttttctatagtaaggagactaggttcagatggttaatctaagacaaataaatgagataagccatacacttttacatcctccatgtcctgtcttttctctgttcaaaataggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactc

SEQ ID NO: 22985 - DNA, 1584 bp, Homo sapiens
  ENST00000367244
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 22986 - DNA, 1581 bp, Homo sapiens
  ENST00000367243
gggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 22987 - DNA, 1257 bp, Homo sapiens
  ENST00000431366
agtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataa

SEQ ID NO: 22988 - DNA, 3944 bp, Homo sapiens
  ENST00000262178
gtgcattgagcgcgctccagctgccgggacggagggggcggcccccgcgctcgggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttttgagacggagtctcgctctgtcgcccaggctggactgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagccagctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggtcggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacgtgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcagcaggtgtctttaactgtcattgtgtgtggaatgtcgcagactcctccacgtggcgggaatgagctgtgtaaatacttcaataaagcctgacttcacatctgca

SEQ ID NO: 22989 - DNA, 1491 bp, Homo sapiens
  ENST00000377633
aaacttcactccccagggctcccatccctggtgacaaagatcacagcagctggcactgcagatgcctttgtgggaggcaccatctgatcatcccgccaaccctcctgcaaccctgcaaggacacaccagcctcccagggtgccaggaggagcctgccagagacccccagagcggcctgccccaaatcacctctgagagcagcagcttttctgaaggaagcctcccctcatggtcctcaggcccagcaggtgccaagctcaatgccagccacgagggcattggctcatcgagtgatgggaacggggacagcaaggcggccacagagagggtggtctcagccatggacacagtacggcggaagcatcccgagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctgg

SEQ ID NO: 22990 - DNA, 1926 bp, Homo sapiens
  ENST00000402066
tcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgagtgcgcccgcgacccccgccccacggcgcctcggacccggttctccccttccgagaagagcgctcctcccgccggtcttcgccttcctcccgggtgctggagcgcgggcggggtccgggagagggagcggggtcgcccggggtccggagcttcctcccggagagcgtgaagcgctgagctccggtcccgccgggttgcgggactcgggttgggaggctgcctgcgcccttccccgcgccccaccgtccggggtttgctggaaacgggatcgtttcttcctggacgcgtcaacgatgagctcgttcggggccgtcccgggagctgggagctgcgggcgcctgcgcgggctgcgcgtttcacggggagatcggggttggcgttggccgcagatgcctctcggtccctccctgtacttactggtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgt

SEQ ID NO: 22991 - DNA, 717 bp, Homo sapiens
  ENST00000421760
ccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaaggccatacaaagggattcatcctcattcacgccggaggtttaaagaggatcctggacccacatacctacccattggctccatgaccagtgcttttataattacaaaatcattgagaaattaagtcacaggaagcctcgtgtgtggtatacactggtgataaagcaagtcccatgcagtctgagatggcaagggaccttctagggaaagggcagtgacccagaagcccgactgctcggctggctcccgcactccgtcctgtggtcagagtgtgtttcctcccctctgtgaacctggtctcctccccagtgtgaggacaggggctctcgccttcttcagggagttgctgggaggacaaaatggagtatatgtaaaagtcatttcctagataagggggagcatgtcgtaagagtctcttgaaatttaattgatgtttatgtcattgacattgaaataatgagaaaataaatccaaatccagagctcaaa

SEQ ID NO: 22992 - DNA, 2810 bp, Homo sapiens
  ENST00000379242
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 22993 - DNA, 1344 bp, Homo sapiens
  ENST00000457137
gtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggcaagtgctcacgtgtgattgaatctaaaccttctgagtccatgaacacgcgacgtgttttgggagatagcggagaaattaacatcttaaccggtcaagctccactggctctggcaatattttaacagatgccaggaacatgggcacagaaatcaatgagatcagatggctggggctgaagaatgaaagctttattttttgtttttgcaattccgagattgtgtctctatatttgtgtcattttcattcagattgactgttgccttgagttttaatgtattgttgctttagaaaatgacatgacattctgtccggaaatgtttcctggcagctaaaaggaaaaagctgtatctacttagatatgaaatgaagagaagcaaagagaacgaggtggtttatgtgataacagcaagctgctcatccaaataacccaggccaaaaatacactgtctacaaggttgtgccaactcagctttcatgtgaaccacaaaagggagtatcggtagacctcaggccaagaaaatacctttttccaggtttctgtgttaaatcaagaactgtactatgcattattgtatctccagaggtgttttgatttcccacacaaagagaaactgtgagtcgcttta

SEQ ID NO: 22994 - DNA, 2650 bp, Homo sapiens
  ENST00000497382
gttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 22995 - DNA, 2438 bp, Homo sapiens
  ENST00000404084
agaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgctgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttt

SEQ ID NO: 22996 - DNA, 2525 bp, Homo sapiens
  ENST00000379241
tagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgaca

SEQ ID NO: 22997 - DNA, 2161 bp, Homo sapiens
  ENST00000401530
ggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctggactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatg

SEQ ID NO: 22998 - DNA, 579 bp, Homo sapiens
  ENST00000464309
acacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatgggcccctgcactggtactggaaaaactcaccaggcaatggagaagaatgggtgggaagagagacggcccccatcagtcagctgagcacctagatgactttcgccaacctgctctattattatacttaggatagaaatggagggctcgtgttgacatccagtctcaatctttcatttggcggtaataaatcactcttatttcagatatgaataggtttctcactgaaacagatacatagatattgataataaacaatcaaaagaacaa

SEQ ID NO: 22999 - DNA, 2770 bp, Homo sapiens
  ENST00000389975
aattcagcactaaaaccagtgtgagaagcagtatgtgtgagcatgtgtgtgtgtgtatgtgtgtgggggggggtgtaaaatgtgtttttcaaagtactgagaggttgatgggactgttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacatgc

SEQ ID NO: 23000 - DNA, 231 bp, Homo sapiens
  ENST00000588915
aaaggacggttcgcagaacaggaacagagggctcagcggcccctgggcggaagacagtttataaaggagaaaatgaagaagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagccca

SEQ ID NO: 23001 - DNA, 2712 bp, Homo sapiens
  ENST00000262291
gacaagttccggatcaagaatcacaaagcgagcagtcattcttcctcttgccacacccacagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctt

SEQ ID NO: 23002 - DNA, 558 bp, Homo sapiens
  ENST00000593168
gtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagca

SEQ ID NO: 23003 - DNA, 544 bp, Homo sapiens
  ENST00000586245
gagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctca

SEQ ID NO: 23004 - DNA, 545 bp, Homo sapiens
  ENST00000585847
agcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaatatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatga

SEQ ID NO: 23005 - DNA, 583 bp, Homo sapiens
  ENST00000587945
tgtctggagcccagcggcgggtgtgagagtccgtaaggagcagcttccaggatcctgagatccggagcagccggggtcggagcggattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgc

SEQ ID NO: 23006 - DNA, 587 bp, Homo sapiens
  ENST00000588131
agcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaagtaaagagtcttctcccactaccttttacatacacctcatttactcatttaaaaaatcctcagtaatctcttactttctgccctctactccatcaaaatggattaattacctttagaatattaccataggaacatatttattctcctttctttaggttgaagaaaaatagattagggaaagacattgctatttgctgtttgcttactggattatcacagttgtccactgttttttcatgttgaatctgcagtggagaacactgaaaaatac

SEQ ID NO: 23007 - DNA, 580 bp, Homo sapiens
  ENST00000589823
gtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgattatttgtccagatgaagagggcactgaaggaaccatttctttgtggagtatcatctcaaaagttaggattgaagcctgcatgtgg

SEQ ID NO: 23008 - DNA, 341 bp, Homo sapiens
  ENST00000592106
gcttccaggatcctgagatccggagcagccggggtcggagcggtttgtaatgtattgctggattttattttgctgtattagctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcatt

SEQ ID NO: 23009 - DNA, 800 bp, Homo sapiens
  ENST00000591315
ctgagatccggagcagccggggtcggagcgggtaggtaaactaactcagggaattggggaccgaagcctgaggctgtcctcagagcttggcgtcttccggagctctcccacttaggcattgcggatctggggcactgtgattccgacttccagcagtgttttaggacgctgctgactggatgtctcaccctggatgtctcacgctggcggtagccaggttatttgggacaccttctcatggttggtcacccggacattgaacccagacaccgggctgttcgttctcctctccgcgtacttggaagccttgctaggcttctttagagaacctcttagtcccgggatgtccaggaccttggactcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctg

SEQ ID NO: 23010 - DNA, 606 bp, Homo sapiens
  ENST00000587259
tgttcctgtcacccaggctggagcgcaatggcacgatcttggctcactgcaacctccgcctcgggggtccaagcgattctcctgcctcagcctcccgagtagctgggattacagccacccaccaccacgccaggctaatttttgtatttttagtagagacggggtttcaccatgttgcgcaggctagtcttgaactcctgacctcactatctgcctgccttggcctcccaaagtgctgggattacaggcgtgagccactgcgcctggtctattatctgtcttttactataaccatcctaacagctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgt

SEQ ID NO: 23011 - DNA, 838 bp, Homo sapiens
  ENST00000592619
acccctcttcagtgaatgaaaagaagaggagggagcgggaagaaaggcagaatattgtcctgtggagacagccgctcattaccttgcagtatttttctctggaaatccttgtaatcttgaaggaatggacctcaaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcg

SEQ ID NO: 23012 - DNA, 791 bp, Homo sapiens
  ENST00000591877
ggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattgggctggaggacaatggcgcactgcaacctccacctcccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaa

SEQ ID NO: 23013 - DNA, 729 bp, Homo sapiens
  ENST00000591782
ttcaaagttcatagttccttctttgttcctttgttaatcactgacttctgactagtgggaggtgcctcccaagtttgctaatgcattctttttggataaggatgacgcacagattgtcctaataaggacttagattgagaaagaccgccccctctgagaagaggggacaatgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattc

SEQ ID NO: 23014 - DNA, 884 bp, Homo sapiens
  ENST00000588617
tttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatga

SEQ ID NO: 23015 - DNA, 4325 bp, Homo sapiens
  ENST00000592790
attttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctcta

SEQ ID NO: 23016 - DNA, 995 bp, Homo sapiens
  ENST00000587470
ccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaa

SEQ ID NO: 23017 - DNA, 3028 bp, Homo sapiens
  ENST00000267202
gggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccgtacattcctgctctcggacttgaactctactgtaactgttttcttaaaggaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataaca

SEQ ID NO: 23018 - DNA, 879 bp, Homo sapiens
  ENST00000535765
ggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgcccc

SEQ ID NO: 23019 - DNA, 2088 bp, Homo sapiens
  ENST00000371248
aataatatctaccagagggcacagagaataaggaactttgtctacctgctacccagccgaggaagtaaacactgccaaccggcggaaccccccgccttgtgctctgccctcagtgtgctcttccccatgtccactgttgtgaattatttatttctctaagtaggcttttgatggacaaaaatgggggctcaggaggaagtgacacaggcacagaggcaggaaagcagggatgggttgtccgacgagcgagttctcgtctactttggccagatggcatgtacttgtgtgtagagaaatgacaagaaatagggctggtgagggggagtgccagggtgtgcgccccatggtggttaatttaggaggaaacaaggagcttcgtgatgattttggagcagagaagcagtcggatgaaactgctcttttttttttttttttttgagaccgagttttgctcttgtctcccaggctggagtgcaatggcacaatctcggctcaccgcaacctctgcctcccggattcaagcgattctcctgcctcagcctcccaagtagctgggattacaggcacgcgccaccatgctcggctaattttgtatttttagtagagatggggtttctccatgttggtcgggctggtctagaactcctgacctcaggtgatccgtccgcctcggcctcccaaagtgctgggattacaggcgtgagccaccgcgcccggcctgaaactgctctttagggaggttaatctgtcagcaaagcgtgggctggcttggcgtggcaggaccaggttggcggcggaagtggaggttaggaagaaattaggatttgagctagggctctgggagaggtattcggaccagctggcccgactccctttctcacttcccctctcctgctgacctgaagtgctttccccacctctgtcacaggcacgtggtctcttagcttctttgtatacctctcctgtggcacttgacacacattttgtaagtcacttccctgtgtcccccactggcttgggggctgcattttgtcatgtttgtctttttgtccttggcacccagcacagtgcctggcacccaggatgtgcctgggtagtgctgctgagtgagtggtgataaccgggcttcaagtggaagtgagtaggagacagggctctggtgagcggggaggggaggggcagtgggggtgcaggagggagggagtcattgaggccggattaggcagagcatgagggatgggcagggctttgtcccgcaggcagttggagtgtggttctggagctcagggtgaatgctctgcttggagacagaaattcaagccactctcctccaagtgcttgtggaaatcaaggagaatataaaagtttgaaaggccactaggagctattagtgggttgggagaaggaaagagctgccatcgaagggaggggagaaacgagagaaacaagttggatgacctaacatcctgttagagactggctggaagaggaacccagaagtagactgcactgtttgaccctcaccggtcggtcgtatgcagagtggttgtgttcttgagctgaggaatgccggccttgttgcctgtttggctttgattacagtatttgtagcagaatgttgctatggagattcatgccagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccg

SEQ ID NO: 23020 - DNA, 1457 bp, Homo sapiens
  ENST00000543590
ccctcttcccccagcttttggtcggctttgctcacccaccaacagctaggagctggaaggctcagaagagctggggtgggcatgggagagacagaggaaccccggtggctggaaacacagttccttcccagggtctcttcagcttgctggttggacctcttagcctgcttatgaagcctgaattgacatcatgccaactggtctcctgctgataagtgattccttaacttcctcgggagcagcagaaacttgttttgaaaaaaatcagattctaaatctttacagctgtttacttctgcaagcacaatggccgtagtaaggaattcaagtcacagcgcagccgtggcagggaaggctctgcatggagtcacaggacaaagcctgtcctggaaacgtgctggaaggaagtcggcctcattctttacgacgggcagcagctccaaatgagaaaccaaggggcttggctctggacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattaggtaactttttaagggtgatcattcgagaataaagagttgagagaaggacacattttcaagctattgccctaccaggaaagaaatattacggaaaaatttcaggttaagatagcgactctactgcaatgaacaaatagcttatgtatattatttatttatttttagagacagggtcttgctctgtcagactggagtgcagtggcgcaaccatggctcagcacgacctcctgggctcaggtgatcctcctgtctcagcctcctgagtagctgggaccacaggtgtgcactaccccaagcaggctagtttttcatttttttgcagagaggttgtcttgctatgttgcccaggctggtcttgaactcaagccatcctcctgcctttgcctcacaaagtgctgctattacagacatgagccactgtattggactagtttatgtatggaatatggagggcccccagacctgcggcctctctgcacttgcggttcgagagggcagggtgtatagcaggactgccccctcctcccagtggccctgactggtggcggtgactgctgaggtcagcccaggtccacacgcacctccagggtctgcagtgtgaagcaggttgcagaaacgtgggtacctcggggcagttaccagaaaaggggctggagattaggaggaagccagccagtttagcagtcaccagtttagaagaggagacttaaccactttttaaattcaagaccccaccttctctaaacagcatagaaaaagctttctgaattatgatattaaacagatgtcttatgacgtttgcccgtttgtcttat

SEQ ID NO: 23021 - DNA, 1148 bp, Homo sapiens
  ENST00000326621
gcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccata

SEQ ID NO: 23022 - DNA, 1191 bp, Homo sapiens
  ENST00000403470
agaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtgagcaggagggctggggggtggcgcaaggagggaggaaagggcttgagttaaaagcgggtgcctgcaaccctcaaactccgacatcattcagtgtgtttaggggcaggaggtgttgttcagccgtggaatttgctggtggcagcagtgtaacctgtgtatttgagggtacaggcaagcggtacagggtggagtggctggtccacaagctgtggcagggaagctgtttgcaggactgccctgcccctcctcatatttaataaagtttacttttctgttccgaa

SEQ ID NO: 23023 - DNA, 1818 bp, Homo sapiens
  ENST00000368100
actcattgcaccttcctgccaccccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggcctgaacaatggggacctggtgttgaaggatatctccagagcagatgatgggctgtatcagtgcacagtggccaacaacgtgggctacagtgtttgtgtggtggaggtgaaggtctcagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtga

SEQ ID NO: 23024 - DNA, 992 bp, Homo sapiens
  ENST00000404666
caaccttcccgaggcgtcctgcccgggaagccagttcctgggttctgggctggctaggttggcagcgaatgaggcttaggcatcactgcctgaggccctcacttagcatgtcgacagccacagacttgtctggcggagtttctcctggtgcccacttaagtagtctcaagtttgttcaaagctggactcctcgacttggaaccaggagcagctggagatttgtcaatttagagctcatttgccacgggagacgctcttggtgtccccagcaccgaaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatgg

SEQ ID NO: 23025 - DNA, 576 bp, Homo sapiens
  ENST00000457525
agtgcatacagaaggcgcttggctcagggtacacagggcaagaagcctcggatcccagctccctttaacacacattttttcaacgccgttctggaccgagactgtccggggcactgggtgctgcaggacccggctcccagtactcctagcagaagaccctctgatgaaatggcccatgacaaaatgaccaccataaccgttccttcagtaagccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgag

SEQ ID NO: 23026 - DNA, 1892 bp, Homo sapiens
  ENST00000295156
gcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtga

SEQ ID NO: 23027 - DNA, 562 bp, Homo sapiens
  ENST00000451533
aatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgacttactggattatttccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggcct

SEQ ID NO: 23028 - DNA, 561 bp, Homo sapiens
  ENST00000483921
gagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgacttactggattatttccagaaggagtctgcctctgtcgcccaggctggagtgcggtggcgcgatctcggccccctgcaagctccgcctcccgagttcactccattctcctgcctcagcctccggagtagctgggactacaggcggccgccactacgccaggctaattttttttgtatttttagtagagacggggtttcactgtgttagccaggatggtctcgctctcctgacctcgtgatccgcctgcctcggcctcccaaagtgctgggattacaggcgtgagccaccatgaccggcccaagtctcacttttttaacgtcactttgctataggttttttggtatga

SEQ ID NO: 23029 - DNA, 2725 bp, Homo sapiens
  ENST00000406397
agactagatttaagacaggtgaaactgagatgctttcttagtttgtcttagacagatttaagtagctaattgaccgattgtgaagttttccggttgctgataaaactattgagcgggtacagtcgagtagcaacctgtcatccgtgggattggtgcaccatttttctcactgtggaagggcagcaaaggtgtttgctaagtaaaactgagtggatgagattggtatggaaatcatggttgatctctgagcgggatgttagtgtttaagatccacggagtcaggcgcaaaatgagcacatttctctcagtattcagaaatgagtagataatttttttcgtctttgatttttgtcacaatggtgaatgggcagaaaagggaaagatgctctactgcactgtcgattttgaacggagtcacaggctcggtcgctgaatggggactgtcagacccaaactagttacctgcctttgcattccgtgttcgccatccggaatctggggttaaaaaatgtaaatcaaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgactttggtgctaacaacgtatgttcagtgcaactacgtggagctgtgcacacacagcaggtaggctgcaggtgtcccccaacataagtcagtaggaaagaagacatctgtcttcccaaatctaaagtaggcaaaaaataacagaagtagctatttttaataacagaacagaactctgactcttttgatcttgaaggaggcagaagagattccatcaaaacctctaaaagcaggtttgcattttcagaacatgcccccctagagagttgagttttttacacagcactacccggtagtactttctctgatgatgggaaggtctacatctgcacagcacgctagctataactgcacatatggctactgagcacttcaagtatggctagcgtgactaaggaactgaattttatactgtaattaagtgtaatttgccacatatagctagtggctttagtaacagacagtttagtgctatattatttattcaagtactttttatcaaattcgttttttaccgaattcgttttttaccattctttatttgtcttaggatcattacataacactaaactagggtctaa

SEQ ID NO: 23030 - DNA, 1488 bp, Homo sapiens
  ENST00000335523
agcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacgctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacaaataaggatgcaactaaaatcagcaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaaaataaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagattattgtgtttaggatttttttttaatttactttttttctttgggggcttttcttttttattaaattatttcttttgaggcattttgattaaaaaagacacatcttatcataattaaaattcactgtcaataatatttatttttaaataaagattggaaacaag

SEQ ID NO: 23031 - DNA, 2149 bp, Homo sapiens
  ENST00000226218
ctttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaa

SEQ ID NO: 23032 - DNA, 609 bp, Homo sapiens
  ENST00000539746
tggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccctgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaacc

SEQ ID NO: 23033 - DNA, 501 bp, Homo sapiens
  ENST00000542029
agaatgagatcatgtctggcctgttgcaagaaccagaatgaaggatggagcagaagttggattggggcggcaagaagggagcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacct

SEQ ID NO: 23034 - DNA, 4388 bp, Homo sapiens
  ENST00000456829
agtcttgtagtcgctactttataaccggtccctagaagggggcggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagtaaatgcagtggttcttaaagtggtctcgtctccctaccccacaatattttggtactgccactttgggaagccaaactaggatagtaaattgaccggaacacagttgtggaaatttgacctgaagttagtgaaataaaacttagtagggaaaaaaagcttagcaagaggtctactcctccatagattcatttattgaacttacattggttttattgtcccttgttttctgttccagcttttctgatgcctccactgttcccatggtatcctgaccctctatcttctgttgtaggctgacttcttttatatgaagcaagtaaaggatactaataagaataccactgtagaatcctgaccatacccttaaatagttatgtgatgatgggcaaatgatttcaccctcaggcacttaatatcctcatctgtaaaactaagggattaaactagaactttattaacactttcgagttccactcagaattcctagaggaacatcggtgacttttcactcagaaagtgggtggactaggcctgagtttctttaagttgttgagttacctggtattaggaagacttgtgtgacttgcatagtggactctaatctctcagtctttcttccaagtttgtttatgctgaatgtgatctgcggaacagggttgttagaaatgcagctttttagaaatgcagaattttaatcgataccaggaactactttatttaacaaggctcccaggtatcatgcatgcacattgaagtttgaaaagtaaaggcttaatattttcatgaaataggcttatatccaagcctgccat

SEQ ID NO: 23035 - DNA, 1863 bp, Homo sapiens
  ENST00000361352
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 23036 - DNA, 1978 bp, Homo sapiens
  ENST00000449321
cggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 23037 - DNA, 2691 bp, Homo sapiens
  ENST00000392744
gactcagagcgctccgggctgcaggagaggaaggtaggggaccaagctaccggtgcagggcctggatccaacccctgctctggaagactgagagctccacattctagctccctttccccagtccccaaatttgtaggggctccttgaattgcacgccccatgggtggaggatttcatcctgatgtatgatccccaggaaggttcctgcaagtttggcagtttaggggaatcttttggaggttgaaggagggatttagccatctcctaatctcaaggcccttcttcctactttccttctcttttactttactttttttcccgctttctttctttgatatagacaattgatgttttctcagtttcaggatagtgtaagctgaggaaatgaggctgtaagcctcatctactccaatcagttgcagcccctaagcccttctctatagaaatgtaagagaccgacgcagtctcttctgtaaatacgtggacattggaaatctaggactgaatggaaaggttaaatcaatctctgattttatccaagccccacttcttaccccaaatctcctccttgtctggttccgagttctccacttcacccctgccacaggccgcaggggtgtgtgtggccggtggtgccacccagctcccctcccaccctcctagctgctgagcggctggtgctgggactctgcattcctgaagcagctacctggctaggccggaagccttgtattctcccagctgcctcagattcatggctttcagcttggtggccagtctctacctaagccttgcaagttgcctttctgaagtgccatcctgagagacagaactaattctgacccaaactaattttgtttgtactgggaagagtgggggcaagggtgcagaatagcaagttttcctcaacggaggatttgttctgagcttagaatcaggaagcgaaggctatttccttgtaggggtgccctttgcgtctctctctcttttactctagccaccttggtgagtattgcccagcctgagagcttctctttcagctgttttactcctgtgtgagtctcctgctttaggctctctgcttaatgtgttattagaaattcttccctcccccagcccagcctgttctaccagagaacttgcccaggtcagaggtctgcgtagaagcccttttctgagcatcctctcctctcctcacacctgccactgtcctctgcgttgctgtcgaattgttccaacttcctaactccaacattaaccctttgaatgtattcttatgccagagaaaggcacataaagtactggtgtttgaacagataacttccaacatgtcctctgtttgtgatatgtcttttctgcagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatg

SEQ ID NO: 23038 - DNA, 540 bp, Homo sapiens
  ENST00000533623
agaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggtagtagagattacctcctcccttcttattacattacctcctcccttcttatttccttaatgcatactctttatgatctctactaaatgtaccttcacaaaacatgctgatgttgaaagctctttcttccactcttttctaactgccatttttctaaaatcatttggggaaagaaatcaatcagaggcattcagagtatagctgtgattagacaagaccaatcacacagtcgctctgcactgctcgtctctttttcagccatgtcaccttggatgtt

SEQ ID NO: 23039 - DNA, 3419 bp, Homo sapiens
  ENST00000392748
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagt

SEQ ID NO: 23040 - DNA, 4120 bp, Homo sapiens
  ENST00000426955
gtgagactctcgcgctggcctctggagcgcggggtgggcgtcccgtcaccctgcgcccagcttccccggcccgttcccgcagggccggcctcccggcgccatgcccggcctgtactgcccctccagctggacgccgctgccgctcacggactcctgggtccgggcctgcgccaacggcccctgcctcagcgtgcgggcccggctcacctaccgcaacccgcagccgcagccggtggacggcgtgttcgtgtacccgctggccgaggccgaggtggtgtccggcttcgaggccgaggccgccggacggcgcgtctccttccagctgcagagccggcgccgctcgcaggccgcctgctgccgcgctctgggcccggggctggggaccccgacgccccgccgctgcgcgcagggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagga

SEQ ID NO: 23041 - DNA, 1633 bp, Homo sapiens
  ENST00000497229
cagtccccaaacaaacctaggagctaaataaaacagtgtgtgcagtgtgcaaatggagctttatgtcctccagcctgcttcctgcttctctattcctcctgcccgggaggagtagagaattctggagccaccttagtgggcaatgggggagctcctgatggttcaggagcaggaaatttatgagcagagtggggtcccaggccacagggagatgtctatccacaagggatggtggccaagggttgaatggaaagaggcaggcagggggagaggggcagagggtgtgggtattcccagggccttgagagtggacatggccccttctcctcagccttccattagcaaggatgtcactgctgctcttgcctgatgacagccagatctgttcacagttagtctgcctctcctgccatcattcatctcatgcctccatcctgcgtcaccaatgcattagcctagtgccaacacgcaaagtcccccttgcccaggctccctgacccaatgcctgcttccacatctagcttcctccctctcctctgcttccagcatgctctgaccccatttctcacccatcataggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacaggttgggcctatggtgattctcttcgtccctccctcggcttctctgggtctagtgcgggtgagggggcactggcagggtacccagggatgggaagggtgaggaagggctggggccagtcagccggagggtttaggggccttcacagtggcccagtgaccctcctcatgctcccttccagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtaccgccataggagcctggcctggcccctggccttggctgcatttgtgcacaaggagcaggcaagcaggcttacattggaatgggtgcggggaggcctcttttctcggtaagatctctccacagctgccaccaaccatcacagaggacagatgagtattgtcattggagggccgatgtgaatctctctggggtgtgtctcagaggatggaggctaggtctgatataaacagaagacagcca

SEQ ID NO: 23042 - DNA, 3486 bp, Homo sapiens
  ENST00000273794
ctcttcgtccctccctcggcttctctgggtctagtgcggccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagacaggtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggta

SEQ ID NO: 23043 - DNA, 3311 bp, Homo sapiens
  ENST00000461141
gcctgtggtgcaggaaggctggacctgcaggctcctcctggacagtgaaactgggcacttggggtccagaggcagggccttccttgacagaattgtgtcctctcctctcagagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagga

SEQ ID NO: 23044 - DNA, 619 bp, Homo sapiens
  ENST00000474580
attcgaattactacaaaaagatgtcccctctgggtggatcagacagaaaaaggccccagagccagtcccactgcccaccctcaacaaagtagcactaagccttgcccaggctgacttgggactcccccgctcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctc

SEQ ID NO: 23045 - DNA, 804 bp, Homo sapiens
  ENST00000493493
ctcaatagtcaaatgtgactagtggctaccacattggatcatgaagagagagaacatttccaagttttattagtgcagaagcaggtggaggaaaatgtgccagctaatgcttcctctgggtgttgtccagagtgctgaatttctgggcagccagggggctcttgctctgctatgggttgaagattcagcctgatcacttcttgtcaaagttggggagtctgagctggttctgggcctagcaaggcaatctactctgttaaagtcgatagagggagaagctggggagaacactgcaattttttctatgagccctctgtagagggtgggtggtgggggctccacagactgctccttggttccacaggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttg

SEQ ID NO: 23046 - DNA, 11299 bp, Homo sapiens
  ENST00000340652
ggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacagtaagtacacaaaagtacactattatatatcaaatgtatttctataatccctccattagagagcttatataagtgttttctatagatgcagattaaaaatgctgtgttgtcaaccgtcctcaccgtgtacctgcatatctttttcagttctgattccatcacccaggaatgttccccctgcacattttcacagggcagagtcacgcatgaatggatcataagatattaggaccaatttccactgaaaccctgtttaaattctatttaattacagacatatctctaatgttgatgtctacttcacataaatatatttcctttttataataatatatggcttttatctgcttcattctcagtcacttgtgaaatgcaggtgtaaagatcactaactcacactttctcagttctttcccctaagctcctgtattgtacaccataggtaagcacatacatatatttcattcttatttacattattttctcttctaaggataactttaattcattccctaaactgaggaataaagtaggctggaaaatttgcattactgttccatcaagctgaagcagacaacaaaataggggaggagtccttcgattctcctaggatagttaaggaaaatcaaactcctaaacaagtttatatacctgaaatctaaatgtgctacagataactcagctgtcagttcagtggaatcatatttgtcatcagacttgagtcatctatcctccataaactacacagtaaaatcttgactgataaccttgaattagccacccttcacaagcagagtgaggaagcagttattttgttaaaacaaagctgaagaccaagtgcactccacaactttcctatagttataattccaaaccaacttcttttctcttcatttgaacagagaacataaaaagccactgcaaagtcctgctaatctaattaatgcataatagaaaatagttctacctttatcaatcatatcagcatgcggtgtgttgatgaaagaggtaattggagtcttaataggtgtaggataaaaaaagcaaaactataatcactattaatgtctttaaaggattaaaatatatataatcattatttgaagcctctaaaggtatttttcatatttttgtttattctgaaattttgcattaagaacctattaagtacaaagcattgacaacaagggaataaggcttgatttcttgccttcttggactttcggtctctggcataagaagtatatgaaatcataatgtattgtattaggagccaaactagagaccagcaaatggagattagaaagccttcctaatgagaagatggagaacatgaaaaaatcattatataaaaaataattcaatcattaaagactgaataacattcaagaaaaatggatacatctatcataattgaaaaattaaactattgtgaaccttagtaagtataaagatgccactgactgagtcatcaaaacactacatatagtcatttaatttttgtcttgttcataaagaacaccttgagccaaaggaactaccagtacatagatttcatgaaaatactcaggggaattattagctaattgttctcaggtgtaatcagctttccaaaatttaacctttgtattaaagactggtagacattggccatccctcctttattcaaggatggattgtttgagacacagttatttaaagttgtcgttttgctaataaatggccctagcccccatgggtaggtgggccattagtaacctcttctctctccatcaggcatgatgcagttagagactcagtccatgcagctcaaagtcttcctgtttcccttaataataattcctaccagaatggatgatgagctctgaaataattgcaatggtgttttcaatgctgtgagaatttcagaaaacctagtattttgttgcatatagagagaatgaacccagtatcatcttgggaagttaactgactcacttgctctaaacttagtttgacctgcagggtcaccagcacacactcctaagagctaaagctcaatggctgttattacaccaaagtaactcccctccccatctctgatttcaaccccctcattcctctctcctcatagaaataatgcataaaccaaacacatggaagaacttggatttttgacactgtatatactcattaataataatggcattatttgcatttttgtccaagatcaacttcttcttgcagttagactttcacaaatacatagctatctcagattgacattctattttcctcccctctgttgtcagagaactctttgctgagattgtcaacaacaaactgttctattcaataaataacctgaataactgcccaataaaaaaggaaagtataagttactcaatttcaaaataatatggtttggagatagcacagaaaagggggcctcagaattcaagtatagaagttctggaaaagccataatcactaaaattcaaataggcctgctctataagtacctaataattgttaaatgatttgttcaagttaataaactaaatcgtgcttacaaatgtattaatgaatttatttcaaattttcaacccatatttagatctgaaagtataaagctacttatgtaagcaatagaatggttctggaaattatctgatgtcttagaggttttcaagttaaattcattctttcagtgataggatatttacttgttgggtggattaacaatactttttattgacatttcccagaagtcttgagaaaagtcatttcaaaaacttgtatttcatccctgcatgcaagaagtattagatgcactccagtccaggcaagtcctgctataatgttgcagctagtgcagatggagaggcacagtgtccttgacatcaaggggtctgtaagccttgaaactaatttaggtttgattataatacttttaatcttttgatacttagaatttcatcacctgctttgtgcagtaaaacatgctaagaagaattatcatgcagttttaagttcataacatcaataatatgtttaataaactttcttccctcgttctccaacataaatgttgcatttatataaggttaaaagtcctaaaaaatcataaaattcagatgtttaatttttgtttttaagcagtgaaatgggtttttaaatgtatacattatctgaaacttacaaaatatacactgtttcaaacaagcattgttggaaactaaatccattattttaaatgtggactatttaaacatgtagaaaacaaaattatagacataaactatgattttaaaaatattaacaatttgctaaatttgcttcaatgggcaagagatcaatcctacttttcattgttatttttaatatcatatttttccccaacataatgttattatgaagagtatcagatgtacaaataagcatcattggtaaaaacatacatgcttctttggccaacataatttgtaactgtcttactgaacctacttacctactatattttttttcctcactagtagcatctgatggttgatacagtcagtaactattctgaagaatcagattaagagagaacaatttacttattcaggaataagtgcatttttacagtacatatttttcacatttcagctgcaacttccaaagatcaggttctcattgctccgtagcacagattaaacagcctacttatgtcatatcctcacttcacaccaacttcttcagtctattattttagttttctaaatgtagatctagttttcaactgaattctttgaggatcgcaatcacacacaaaataacatccaaactcctcaacatggaagactggtgtcttcacaattagatcatggacaacaccatgacccaggcccctgtggctggtgagacttctgggccctgggtaccacagactatactctaaacatggtctttactatctcagatcctgccctgagtgtcctttgcagcatgttgagtattagccattttcaatgtccagttcaagtgccattgctggtaaggcttctgtagttcttattggaagaattgtcactctatgtcccagtaatagtactaatttggtttcttattttaacatatcatttaggaatcataccatagtttgcataatggttaattttatgcctgcttcttctattatttacaaatccctttagtttgggctgtgaaatattcaattcccaaaacatcacccaatatctatatgttaaaggcttgttgaattgtattccatctattagttcagagttatttgctattcttgtttaaggacaatgtatgtattaaagagcaactaaaaactcccattactgtttgccaacccagttgtcttttgatttctctgtcaacttacaagtatcaaatatctaagtcacagaacccagagacacatcaaataccccaaataccccatggtagttttcggatgaactctgacagctattggccatttctggtgcaagtcagaaaaaaattgcttttagtgtgaaatttttgatgctgaagaaagttgattgtattgaagagacactggccctttatgataaaggaagtcaagtttacagttttgatatttgtttactttcttatttctaatttttggaaaacaattttcttagactttcatttgtgatattgatcatttctgtgtgttttaatctttctacataacataattaaacacctcagtaggtatctagtgaactgatacaataatgagctgagtcatttgtacagaaatatagtagcttccataatctgaatgataaccatttaaaagtgatggttgttgaaattttactgtagtgtcaaatttcactttaaattttgcaaagcacctgctattctagccttaacacaaagatttggctaatttttaaatgaacaaatcccattgaatattaagtgacactgacaatcaccctgaaaagtattcagccaaagtttcaatagaattaggaaacttaaatgaaaatgtgctctcagtgcttggcccatgagcagtttatgatttaagacgtgcatactgtttaactctttcctttaaagttcagaaaagtacataaaacctctggctgacctattatataggcacagaattatcaaaagcaatcaaagtatgtacctaaagtcaatttagtatattatgaatacagcctgatgactaaacacaattgcaaatattgcgactttagtttttaattcaattttcagcaagtagaaatatttctcaattttatttggtatctaattatattaagaccaacatatacattaaagtgtatttagatgattaatatttaatgatcattattttatttaatgattaatattttctattatttgaatttctgtaatttatgttttagaaagaactgtttccaaacacattttatggaaagatttcatttttccattccctttacttttatatttacattgtcaaataaatacaattctattttcatttctattagttttcagggtttattcttttcctaagcatataattcttataatggaaaaaagtgaaaagtatccagtaagtaatatacacctatgaaactattaatgttctttatactaccaagtagtttcatagttttaaaaagccattcttaagcagtcggtgaatgtatatcatcggccaaaagttatgctaggtttccttcacttattatcacatttaacctcacagttctcccaaattgtgggtaatgctatcccctttgttgcagaaaagtaaatataggctcagggaaatttaaaaactgccttaagattcagtctagtgaatgagaggctgagttaagaatccaaatctgctttatatcagagcccgtgatttgaagtcttatcatttgtgtttaggtcagggacctctagaaaatagacagaaatttccaaaatggtcttttaccccactccccataaataagataatgaatagcaacactgatccctaattctagaatatcaatcttgatacttgtcaaagtaaatagtagctcgtcacaaaaatgttgtagcctccctagtctaaatgcttatgctatattttgtttcctaaatctagagatctctttttaaaaatagtattgaagcatcaggttgttcaggtatgattctcatattgaaatttacaaaatataaccaaatattgtgacccagtttttctggagccaagagaagtaaactgccatttattaggtgatgattatagggcaaacactacaatttcaaatttcatattcttttatctgatttattcattttatcaactctgctatattgatgaagaagtcaacatatggtgggtaacttatccaaatttcagtgatgggctgggcgtggtggctcacgcctataatcccagcactttgggaggctgaggcaggtggatcaggagtttgaggccaacctgaccaacatgtgaaaccccatctctactaaaaatacaaaaaaattacctgggcatggtggcacatgcctgtaatctactcgggaggctgaggcaggagaatcccttaaaccgagggggtggaggttgcttgagccgagatcgcgtcactgcactccagcctgggtaacagagcaagactctgtttaaaaaaaaaaaaaaaatcagtgatggaactgaggccaaatctgtctggttccaaagctatcctacatggggcacagtcaggactggaatggatagctctacctgcttccaaatattcttccctggggagcagctgtgagtcttactgaatcgatttattcattgcattctatgtgtcaactgcaatttagacctgggtgatagagtcatatatggtctttggacccatgaagctctgagtcaaggataccagcagatatccttaaactaataaaaaaagcgatggcatcacatgccattttgaacttttgcattaaagtcataaacttacatcagtattatgatttatacttttaagcaaaattttgccattttctgatacatagtagctagctagtgataaaattatgaagttaccattgtatgttccaatgacataaaaaactaagtgcctgcttgggctagttatactctgcagtataccctggtttattgtgaggattaaataaaaaatcctcacaaaccccaatttaatttaatatagattaattataaaaataatctacccatgttacataatgttaaatctgtagtttcaaggtgtatgctatttcttaaaacaaaaacaaagattgtccccactccaaacaataacagcaatggtgaaggttgtgggtggacagaggtagtcccactcatccccagggggctcagctgccaccggccaggtctatctattgctcccacctgctctgactgttttctctcaagaaaaagattttcattttaagataggcatcagtgcaataaaggagcttgatacaaaaatcattatgttctatatatgtttttgtaggttttagattaattatggccaactgataccttaaaatatttgttacaaataacactgaagtgagattcaaaattgtgccttctattgaagccaagaaagtaaatgtctttaaaataaacataatggtgtttttttttggtacaataaacagcatacctacatttcagaggacaaatcatgttattataataaccaggagagaaaataaaaggagacattaatttggatatggaagcaaaatggaacagagcaatatagagcaaaacagaggtttgtctgaaacatttaaaatattaagaagtatgactaaaaaactcaaacattttaatacacgatgaatccttttcttaaggaaaaaatgaaaataataaaagtggtatttggatgagataattttcctttaaatttattcctcagaatgatgtaaattttccagctggaaggtcatctttctatacatgcatgcatctatacaaatggttaaacagttactctctcaatttgctgtgataggaaaggtggatataaatataagcaagggtctgattaaaacaaaacaaaacaaacaaaagacaagagaagcactgcattgttggcaagaaattccttttaagtcagacttaagtccacggaaagctggacctaagcagtgaaggatgtaagggaacagagagagactctgcttggccgagtttgctattctcatttgtctatgtcaatacggctacataaagttcacaactatttgcacatagctataaatatagcatgaataaaacacatatgtatttaattgtgttatttactatttataatttgaattgtttaaaataattttaaatacttattccataaactcagtatttgaaaacttaaaaaaaaagtcattttaaataacatcatttaccaagtctgtgtgatgctttacaaggtacctgatgaatgtaaaattatagctttttgtcttcatttctaatagactgttataggggaaatgtactaaaatgttgtacttattacatttatgaatttctgacagtttctatagactgagaataatgatatgcttttataaattatttggtgaaagttttccagtaagtgttcatgtcctgtacaaatttattaaacaacatcaattttacctaacaactgtaaccactaataaatcatcagtcaccacctttcctgcatatctgacagatggagaacactgtgcttagtgttgaagataccaaagggaattcaagtgaggggaaaagaggagagcaaactgatcaaaagggaatgcccatgatgctttcaggaaaccagggtgagaacatgctggctggaggatgggtctggtttccagcagagatgataggagttaaaaggcataggtgagttgttcccatccctggcctgagccttactccatagctatagagacatagtctctagaaacaaaggccagagcatccttttaacatttatatcataagtattctcaataaacgtttgcaatttatttgctttaatgtaacttggcagtaaagactttggcctttggaggtctgattctaatcccagttctaccacttactggttatttatcaggtacacgttacctacctctctgtaactcagattgctcatcagtaacatggggagagtggtatcaaccactaagaggattaaatgagtgaatatttgtaaaacacgtagcctagaatagatatttataaagcacaagatctatgtaaagtgtttataacataatacattggaatatgagacttgaacattttgaagattctaataaatgaataatttaatttagtgctcatttgaaaaatattttatcctcatgtttacatttaacacatataatttatatcttagtttttatcccatttatatatatatttaccagaaaaatgttttgtaataccttaattttatgtggagttgaatttaaataattaggccgaatttgtatgtattgttggatgggtatgtgtattgacctgatttataaaataaagtatttattaaactga

SEQ ID NO: 23047 - DNA, 1351 bp, Homo sapiens
  ENST00000488147
atgggagccgtgtgcacgtcgggagctcggagtgagcgcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggctggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcgctccatggggggacggctccacccagcctgcgccactgtgttcttaagaggcttccagagaaaacggcacaccaatcaataaagaactgagcagaaa

SEQ ID NO: 23048 - DNA, 3884 bp, Homo sapiens
  ENST00000333538
tggaggatgcgggctccccgagcgggcttcccctctgcccggcgcgatggagcgggtcggtgagcggaacaaaggcgcctgcccgggggagcgggtcttccgctgaagagcgcgggtggcgcgccgcgacggccgcctgcgggccaaggtgggaggctgtgcggccccaggcgcggcgcgctccgccgtgggcgggcggcgatccctgagtccggcacctgtgcgccgctccctctgtgcctcccgggcagccccgcctgccggcctcggagtccgcggcgccggcggctagaggtccagaggcgaaccacttgctggtgcagaagagaaaccctcaaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgaggtgggacgagcaggggcttggatccctgccggccgtctggtgtgtgaggcttgcacggcccctggctgccccgcgcctcgccggagcccgagggggcgcaggtccggggcgagggccggccgggctgtttgatggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccca

SEQ ID NO: 23049 - DNA, 3653 bp, Homo sapiens
  ENST00000498380
aggacatgggcggggacaaataagggaataaaagctggcggcagggaagcccgcagctgcaaccggctctggttcttttcggtgctgtggaagctttgttttttcgctcttcacagtaaatcttgctgctgtatattctttgggtccacgccgcctttgagatgtaacactcataacactcaccctgaaagtccgtggcttcattcttgaagtcagcgagaccacgaacccaccggaaggaaccaactctggacacagtggcatgatctcggctctctgcagcctctgcctcttgggttcaaacgattctcctgcctcagcctcccaagtagctgggactacaggtgtgtgctagcacacccggctaagttttgtatgtttagtagaaacgggtttcaccatattggccaggctggtcttgaactccagacctcaactgatccaccggcctcagcaccccaaagtgctgggattacaggcgtgagccaccacaccaggctgagatctgacggttttataaggggcttttcccccttctgcttggcacttctccttagtgccaccatgtgaagaaggatgtgtttgcttttccctccgccatgattgtaagtttcctgaggcctcccagccctgcagaactgcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccag

SEQ ID NO: 23050 - DNA, 566 bp, Homo sapiens
  ENST00000447516
ttgttggatttcaaaaccaagacgacaccacctcttggtgtgctggcagacacagagagaggactgtctgtcttccctcctgtgtccctctctgccacagctgaaatggctgatcttttcagaatcactgactgggggatgttcatgagcttggacaggataacaaatggaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgcta

SEQ ID NO: 23051 - DNA, 3183 bp, Homo sapiens
  ENST00000467723
gtctcctctcagctaggactttctgtttgcacagccgaggcctgcagggtacattccagaggtggacttggggctggccttgaacttccagaccctctctcccctctctggccggggctggggaaatgtcagctattctgagggccttggaagctggactcagttattttcggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccc

SEQ ID NO: 23052 - DNA, 3012 bp, Homo sapiens
  ENST00000618959
ggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccc

SEQ ID NO: 23053 - DNA, 854 bp, Homo sapiens
  ENST00000320531
gcttctcccagctggagtaggtgggggaggccagacatggaggcccttcctccagtcagatccagccttttggggatcctgttgcaggttacgaggctctcagtgctgttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctctgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacctggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcctct

SEQ ID NO: 23054 - DNA, 961 bp, Homo sapiens
  ENST00000426490
ggagtaggtgggggaggccagacatggaggcccttcctccagtcagatccagccttttggggatcctgttgcaggttacgaggctctcagtgctgagacagggtctcgctctgtcgcccagcctggagcgcagtggtgccggctcagctcgttgcagcctccaactcccggtctcaagcaatcctcccccctcagcctccaagtagccgggactatagttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctctgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacctggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcc

SEQ ID NO: 23055 - DNA, 4294 bp, Homo sapiens
  ENST00000508596
gcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaa

SEQ ID NO: 23056 - DNA, 456 bp, Homo sapiens
  ENST00000509792
atcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccagatggaaatattaaagtgaagtcatgtatcttccagtacgtcttcaggaacagagatttcatcgaaattatattaatttatagaaatcatatgaggataggctgcgtgcggtggctcatacctgtaatcccggcactttgggaggctgaggcaggcggatcacctgaggaagttccataaatcttgcaacatgggatggccttcttcagtgatactattaatatagcatgtgcaatttctatttcactggagtt

SEQ ID NO: 23057 - DNA, 4705 bp, Homo sapiens
  ENST00000280190
gcggggagggtccgcgcgttggtggtgctcgcctcgcagctgcgcccgccggcttcagcaccttccgctgtccgccgctgcagccgcctcctcctccaggtgctgactattctgatgccgagtttccaattgccttgattaaagtagaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacagtgtccccttttgttacgttaacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttt

SEQ ID NO: 23058 - DNA, 4119 bp, Homo sapiens
  ENST00000507824
gtttccaattgccttgattaaagtagaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaa

SEQ ID NO: 23059 - DNA, 466 bp, Homo sapiens
  ENST00000513261
gaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagac

SEQ ID NO: 23060 - DNA, 677 bp, Homo sapiens
  ENST00000505894
ggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccagtttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgag

SEQ ID NO: 23061 - DNA, 4911 bp, Homo sapiens
  ENST00000443118
atggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttttaaaaaaaagaaaatgttaccagtttttttatctgaagtttaactgtcccattgtaaaggtgtaagttatataggcttgaaaaaaattggcgggtaaaaatcacaaaatgcagtcgaatatatatatgaaaacttgcattaggtgataaagtgactattttaagagattcagcatgcatggatattagttttgattaatgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttgatactcaagttgtttcacaagatttataatatagatggttttgtttgactaaagaataatctcatataactagaatacttgtggcttttattatctttaaacttgttgcatttaaaatatttttaaaaccttcttaacaaaacttcttaaaactggaaaaaatatatattatgtatctatgtatcatatttatcacatgaccacttttgattccttaaaaagacattacaggcttaaattccattttattaaaaaaaaaaaattgcctgtaatcccagcacttcaggaggccgagatgggcagatcttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcggaggttgcagtgagctgagatcgcactactgcactccagcctgggcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcattctttttattttaaaataaataaataagcctatctttttgtgcttacatacttaaaaggatatcattaagtatataaacaatcattacttctgtatttttaatgaatgcaggaaaataatatttttatgtataaaagatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatattgtaccttaatatgaaaaacaaattttttaattcataaaagtatttttattagatttcatatgcatgaaacccaagcaaattatatgaatttattttactatttgaaaatgttcatattaccaataatgtggacaaattactttgcaggtttaaatatgcctctgtaaaggaagagtctcattagacaatgatttttaaagcattggaaaaatattttgcctgtaaaagttagtaactaggtggttcacaaaattacaacatcaaaatagttacatcttgtgaaaatatatgatttttatgtcaatcaagacaaatgaaatatatatgtatgtgtatatatatacatgtatgtatgaaatatatatatgtgcgtgtgtgtgtgtatatatatatatatatatatatatttctatgaaattgtccagatgtgttcaggaacatgattgcattagagcaatgactgtattttgttgtccttataacatttatattatttcagttttaagtcaaaaggtattctgaatataataaaagcctcacaaattatttgtaaaatttagtagttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatat

SEQ ID NO: 23062 - DNA, 485 bp, Homo sapiens
  ENST00000508773
gtttgaattttagtaacattgttttcaaatcaattattttctagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccacc

SEQ ID NO: 23063 - DNA, 2587 bp, Homo sapiens
  ENST00000392325
gtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 23064 - DNA, 2322 bp, Homo sapiens
  ENST00000572583
ctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgta

SEQ ID NO: 23065 - DNA, 779 bp, Homo sapiens
  ENST00000576517
ccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaatttt

SEQ ID NO: 23066 - DNA, 654 bp, Homo sapiens
  ENST00000573656
gtttgggtttgactcttgaggaaagcaactctgatcatgtttttctttccagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaa

SEQ ID NO: 23067 - DNA, 869 bp, Homo sapiens
  ENST00000571835
aacatagaaagctctgaatgtaaccctggtctttctgtggggagaccctttccccctcttcagctgcaggagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgca

SEQ ID NO: 23068 - DNA, 896 bp, Homo sapiens
  ENST00000573616
acttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattg

SEQ ID NO: 23069 - DNA, 252 bp, Homo sapiens
  ENST00000577774
gaattggcacctccagagtgggaatgttgaggtgttccacagtgtcgacaagtgctgtgggttaagtctctggactcctccacatccacacaaggcctgagctgtgctggttttctctgcagcatcaacttcaatcaggatgcgtccctcatctgcgtatccagcgaccacggcacagtgcatatttttgcagctgaagatccaaaaaggaataaacagtccagtttggcctcagccagtttccttccaaaa

SEQ ID NO: 23070 - DNA, 789 bp, Homo sapiens
  ENST00000571767
tgagctgaggttgtgccactgcactccagcctgagcgacagagtgagactccatctataaaaaaaaagtaataataataataatgcaaacgcttgagccagatcgaggatattctactttcagacttttcttattttttccagacacagtagcataaaaatatcacttctgtctgttttgctcggttctgaacctagatggagtgtttgatgatgtctctctgaacctcagagacgtctcttaggctgaccttcacccaggcgagaagcactccctcagcagagccagcccacgtgcactcgccgagctccaggcctggcgctggctacctgcctccagagctttttcttcaggaacactccttttctgtgtgaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcg

SEQ ID NO: 23071 - DNA, 889 bp, Homo sapiens
  ENST00000571817
cggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaaggaacagagaaatgaaatgggaagagattatcggtaggaaaaacagtggaagacagggcttgagatcttggcctttgagcggttctgtaatctcacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatc

SEQ ID NO: 23072 - DNA, 765 bp, Homo sapiens
  ENST00000574828
cgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagggctccgctggaggtaagtaggtggtggcgtggatgacgtgcgccacagtggaccagccagtgggtctcaccgtggtgagttatgtcccattccgacatgtgcagagctgaggacatgagttttgagccttgaattaccctgggcttttagcccctgctttgccaaatgctgcctctcaataaaggttttcggtttgaaggtaaaggaaaattgaatttt

SEQ ID NO: 23073 - DNA, 2594 bp, Homo sapiens
  ENST00000308378
aggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaactaaa

SEQ ID NO: 23074 - DNA, 1996 bp, Homo sapiens
  ENST00000476376
agcctgtgggtatcatgaagggagcaagcaacatcagaggttagcctgctgcagtgatcccgtcaggcctgatggtaacagcacagcaggagccaagcagaagcaagtctccagcttacagccaattaaacaccttctcaatgtgaagacgacacgaatgaagacccttatgataattgacttccactcaataaatagtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 23075 - DNA, 2215 bp, Homo sapiens
  ENST00000472600
ggcctgctagtgcatgtgaagatggagaagccactatgaccattaactgggcagagctgctctctggatgtcacaaatgttgccatatattagagcataaacttcatcaaggagattgggtcaggcaagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagaggtatgattatgcctcatggaaaactataggaagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 23076 - DNA, 2108 bp, Homo sapiens
  ENST00000479765
agaacagatgaaacaaacaactccacattgctgggaaggtggcattcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagtccccacagccaaggaaaatcatttgtatgtccagagaagacttcacgcagaagatgacagagattgttggttggggcacgaaggaagaatatggggagctctttgacaaagtggatgtggcccaagatggcttcattaattgggacaagctgacttcatttatactgctagagctttatgagcaagatgaacgagcaaaggcaactgtggtgccccagtggaaggaccttgaattcctcccagtaaaacacaaggacaccattcaaaaagtaattttcttaaaaaattcaagtcattatctgacaattagtaaagaaggtttattggcaatctggggagagcatttaaagctgcaagaaacattccccatcacttcagatgccaccaagctcaaacacctgtgggtgacaagtctggtttctctggaaaatgtaaacaagatagcagtggcttttacaagtaaagaggtttgtttctatgatctgctgtccaaagaagaatttgcttgccaatacaaactccaaggcctgaaaggaacaccaatttgcatggattattggtatgatcctcttgatgccaatgaatcaattctttcttttggggatataactggaaaggttcaagcaattgctttcaccgcagccttgatttccctgtttgaacggcctgctagtgcatgtgaagatggagaagccactatgaccattaactgggcagagctgctctctggatgtcacaaatgttgccatatattagagcataaacttcatcaaggagattgggtcaggcaagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcagccttctcaatgtgaagacgacacgaatgaagacccttatgataattgacttccactcaataaatactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 23077 - DNA, 416 bp, Homo sapiens
  ENST00000493061
agattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaa

SEQ ID NO: 23078 - DNA, 1108 bp, Homo sapiens
  ENST00000460448
cttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaa

SEQ ID NO: 23079 - DNA, 575 bp, Homo sapiens
  ENST00000466760
agatgaaacaaacaactccacattgctgggaaggtggcattcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtca

SEQ ID NO: 23080 - DNA, 521 bp, Homo sapiens
  ENST00000488012
attcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagatagcagtggcttttacaagtaaagaggtttgtttctatgatctgctgtccaaagaagaatttgcttgccaatacaaactccaaggcctgaaaggaacaccaatttgcatggattattggtatgatcctcttgatgccaatgaatcaattctttcttttggggatataactggaa

SEQ ID NO: 23081 - DNA, 570 bp, Homo sapiens
  ENST00000471198
agacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgaggatggggatatttggctcacagagcagcactacgagtggctaaagacaagacagaagctgggattactcacatggatgaaatgtcgctcttgtatatgtgaaagagccatggttctgggaacagtccccacagccaaggaaaatcatttgtatgtccagagaagacttcacgcagaagatgacagagattgttggttggggcacgaaggaagaatatggggagctctttgacaaagtggatgtggcccaagatggcttcattaattgggacaagctgacttcat

SEQ ID NO: 23082 - DNA, 4467 bp, Homo sapiens
  ENST00000288912
tttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattgtatccgagttcatacttctccaccccatcttgccaaggttgcggaaagtaaaaattggcagtattggccgctgcagcttcttaggggacgggaccatgtgaaaaggtgggatcgtgcgagcggaggaaggacagaaaagcgaggaaagtctatgccgccagcgaccggcaggaggcacgtcgggcacgctcgtcaccgtttcctggcacgtgaccaccgccctgccctgtcgctttagggcctgtcgcttccggcggtggcggttgccatggggacggagcttgggtggcaaccagaactagggagctggtggagaaggtggcggccgctggaaggaggcccgggaggtggctgaggggtccaggcggcgggacgactctggccttttgaagaccgggaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaa

SEQ ID NO: 23083 - DNA, 3420 bp, Homo sapiens
  ENST00000397454
agaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaactccaaggggtctgatgactgcccaagcaatggaggaggcagtggagctgggattcacagccagggctttctaagtccaccccacaccttaacaaacattcattacaggaggaaaataaaggacttttgtctccaatctttgtgatatggtttggctctgtgttcctacccaaatctcatcttgaattgtactccgataattcccgtgtatggtgggagggacctggtgggagatggttggatggtgggggagcagggggtggtttcccccatgttgttctcgtggtagtgaataagtctcacaagatctgatggtttgataaggggaaacctgtttcacttggctctcattctctcttgccactgccatgtgagacgtgcctttcaccttccgccatgattgtgaggcctccccagccacatgaaactgtaacaataaacctctttcttttgtaaa

SEQ ID NO: 23084 - DNA, 2555 bp, Homo sapiens
  ENST00000540779
gatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcaggtatgcagggatttccttcctacaggtgggggagttgtctttaacgtgcgtgtggtattttgttttgtatctcaagggctgacttcattctatcactgtcgtattttcccactctccttggaactaaaagcaagcctgtctttagaaacacatggtattgtttattgtctctctgtttctaatcagaatcaacttacaaaacagcagttgatattaattttatagtgagaatttaaaacatctgtattttttacacttctgcaaaaatgtggacagcgtagatcatatctccacagatataacacaaagggcagctattcagcagggtgccgacctcacggacacttacacacatctctagttttcaaagggctttcatcttataactgtaccgagaagtgggtattcatatatccattttacagaagaagaaactgaggctcagagtgttttaagtgacttgcccaagactgtactagtaaacaatgactctacatctcctgtcttgaaagtgttaagtaggtcagttgtccttttatccctccctcctctcagcagctttgctcattttcacccctctctgagcctcccccatttgtccttcatgcctgccctcctcacagcactctgcctcctttgttcctgatatttgggacccacttcattttcatcatttacctttccaagcatcctattccttggtgtctgactttccactcgttggcctggtcaactgttccacatcaccctttcagttgacgtgtgttgttacaggagtgtccttagctgatgcctagatcaaaaacaccacgaggtatttaccaaggacccagtcagtactcagtgttgtgccagggactcaagatgtctgggtgcaacttaaggaattcactctctagaagtccagaaatacgcaggcagaaatcagcaggcagctccccttggagcttcattgaatgcatggcactgaacacagtggtgatggcagagagagaaggagagattgctgtgggcaggctcagatagtcaggggaagcaggatgcgcagatgggctggggtggaaggaggcaggagtccagcctcactagggccagagggctgggagtggccttgaccatccattcgtttcacaaatagttatagctgctatgtttcacagtataggtctgtagtaatgaacaaaacagatgtattccctgctctcatggagcttacagtctagaacagagacagatgttaaacaagtgaacacataaatgattacaaattgtaaccagtgcttgaaaggagatgtgaaaacgctctaagggagaaaaatcagggtaagagaagacttaactttagattgagtgggcagggattgaagaggtgctgtttctgctgagacctggaggatgcgaatgagccagccaaagacagtctgggggagaacattccaaacagagggagcaacaagtgttcaggcctgtgtgtggggcctggaaagaaggctggtgtggctgctgcaccatgagggagacagagaaggaaggagggaagaggggccatttcccagcagggagtgctgccatttgtgttcccagaagattcctctcttgtgtgcataaaaggattgtaagaagataagagtggaagcagaggccgagcatggtggctcatgcctgtaatttcagcacaggctgtggccaaggaggctgaggtgggtatatcgcttgagcccaggagtttgaggccagcctgggcaacatggcaagacccttgtctctac

SEQ ID NO: 23085 - DNA, 528 bp, Homo sapiens
  ENST00000546044
cacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatgggtaagcagaaatattttgatttgttttaaatgtgggtagaagtatgtgttcattctttgagtacaaatgtttcagtaatgtaacaatatagtatctctacttaggaagcaatgaatatatattaaaatgtttttatttaactgtagtatt

SEQ ID NO: 23086 - DNA, 4675 bp, Homo sapiens
  ENST00000543211
gaggcttgagatgacttcgtccaaagaagactgacttctgctccttaaaggcacttagcagagtggtcagcttaatctaatcagagcttgaggtcgtttgaggctgattttcaggctttgtgaagtctgcctcatgcacttgcttttgccagttccttaccctacccaggcttttgtgctgttctgatatgaattctcaaacactggcattagtagtttacacccctgtggtatgtaacattcataaaatgttcagaaaatgataggtaaggaataggcgtggagacggggtggaaatggcagaaatggaacttaaaaagcttttttccagcctgtccctcagtgctgtctcctgcagcccttctccccaggctgtagccacccacctcccatgcacatttcaaacacataccccatggctccccaggaagagcttgctttgttgttcttgctgtggctgtttggtttctgtatttaaaactttccgtcacttccatagtttctgcagggttggtttttgggaagggagccagcagcccatgctattcaccatcttggcaggaattagaatccccttccaatatcttgcattcattccaagatattgtgtggccctgtcaaatttagaaatgtatacgcagcagtctttatctaaaaggatacagaataaaggttattggtgaatactggtttacttttgcttgttccaatttattttattattattattgttattattttaaattgaccactatcagaaaagcttgttatagccaggcgcagtggcccacacctgtaatcccagcactttgggaggctgaggcaggtggatcgcttgaggtagggttcaaaaccagcctggccaacatggtgaaaccccatctctactaaaaatataaaaattagctgggtgtgggggcacatgctggtagtcccaactactcaggaggctgaggcaggagaattacttgaacccaggagatagaggctgcagtgagctgagatggcgccactgcactccagcctaggcgacagagcaagactctggctcaaaaaaaaaaaaagaaaagcttattctaatttatagatgatgaattataatagatcaaactggaaagggaacacatttgacactgtttattttaatcaccagtatttaaatgatattcctatttttttttacgaaatgcggtatcttttctgttttatattcctactcatttgttttaattaaaattattatttaattttaacattcagcttaaccagaaacagaaaatttatcattaatgtattttcatactttatatttcagaactacgttacttttaacccaacaaataataaagaattggtgagcaatagtaaaacacgggcaatatattatgcatgggtaagcagaaatattttgatttgttttaaatgtgggtagaagtatgtgttcattctttgagtacaaatgtttcagtaatgtaacaatatagtatctctacttaggaagcaatgaatatatattaaaatgtttttatttaactgtagtatttagtcctattagaaattagcatattaaatcaaaagcaaataatccaattttatttattaaattttattgaagtaatgaggcaaatgtttatttgaatttatttaacaagactaaaatacaagttttatggtttttttggagatgaggtctcactatgttgcccaggctggcctcaaattcctgggctcaagtgatcttcccgcttaatcctctcaagtagctgggattagaggggtgagccggccacacctggctctaaaatacagcaggttttttttttttttttttttgagaccttggtcttttttcccttttagaaaggaattagcaaacagattagtgatacatatactgacacagggcaaaatcatgagaataaaaaacattgaggctgagcacagtggctcatgactgtacttccagcaccatgggaggccaaggcaggaggatcacttgaggccaggagtttaagactagcctgagcaacataacaagacctcatctctacaaaaaattatttaaaaaaatttaacagtgcatggtgatgcatgcctgtagtcccagctgctcagaaggctgaggctggaggattgcttgagcccaggagtttgagactgcaatgagctgtgatggtgatggtgccactgcactatagcctgggcaacagagtgagactctgtctcaacaaaacaaaacacaacaaaacaaaaaacgtttcaagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaataggtaggagatttccttttggggttatgaaaatgtcttggatctagatggttgctcagcattgtgaatgtatgaaacaccgctgaattgcacactttaacatggttatgattaattttatgttaagtggattttacctcaataaaaaattgtagaacaaaaccaaaacacattgagtcactgattgtgagtgatagtcattatttaagatatttattatagctttattttattttatttttgagatggggtctcactctgtcatccaggctgcagtgcagtggtgcgatctcagctcactgcaacctctgcctctcaggttcaagcaattctcctgcctcagcttcctgggtagctgggattacaggaacctgccaccacacctggctaatttttgtatttttagtagagacggggtttctccatgttggccaggcttgtctcaaactcctaacctcaagtgatctgcccgcctcagcctcccaaagtgctgagattataggcgtgagccaccgtgcccagccgattgtgactttacatagtacttaatgcaaattcgaattctctattaataagcctttaaaactttaataaataccttaaggtcggccgcagtggctcacgcctgtaatcccaacactttgggaggctgaggtgggcggatcacctgaggtcaggagttcgagaccagcctggccaacatggcaaaaccccatctctactaaaaaaaaaaaaaaattagctgggcatggtagtgcgctcctgtaatcccagctactcaggaggctgaggcaggagaattgcttgaacccaggaggcggagtttgccgtgagctgagatcgcgccactgcactccaggctgggcgatagatgtgtttctgcttgaagacaccttatttaatatagaactccatctcaagaaaaaaaaagtcataatcatttgtggcattttttatattttttatgtatttgcttttctttcagaatgtttttagatatttcccaagacagcaagttctcttacctgtagaaactgcaaatttctgaccttgtttagatgtatttgttttgcttttattattaatgccgttcttcctttggaaactgggtctttttgagtagtgattattttttcctcttatcagtatgaagagagggatacactggctcacagtgccccacttttaactgaaaaagggaacaatgaggtcttgacatggttttacaaagagaaatgcaaattgtcaccctcactcagtggagcgagaagataggagaactgcagttggccatgcaatcaacctttaatcggttggggtttaggatccagtggagaccaggcctgggttctccaagttaataaaacccagtcaggacctgggagtccaagaaggaaaaggtctctggaaatacttgctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaa

SEQ ID NO: 23087 - DNA, 2883 bp, Homo sapiens
  ENST00000535257
gttttctgcatacttgcttctctctcggtatgatttgtagaaatttatttaagagggcatgccaaaagacaaaaacaaaaaataaaaagttgagatggatgggcacaatgagattattctgtctgcagacttgtttttcataaatgaaagtactaaaaaataccatcagttctcattattgttggtagttatgttatataaagtctctgtaaacaccaaattagcagatacttaactattgctcttaagggaaatataggggtaggtttctgtgagcctctggtcacattttcaccaattgatcaatacataagcttgttttatgtgtatttctatttaaagacactttatttaatatataacattgattcattaacattgaactcatggccaacagcactataactcatgacttgaacaaaactcatctaacctacatattttctccataaagcacatcacagcattcttttgcttaggaacactagccagcacttcagcactatgtttcagggtcaatttaaatactaaaatcaccaagaaaaatgcaaacaaccaaaaatgcaaacaacatggcactaaatagaccatgaaaaggacacttgtttatagtcagagctgagacaagaaggcggagcattgccctgcctgccctcaactggaaatgtgcatgttgagtgagtaaaattatttgtcacactgcacatgcacttctgcaaatgaccgtgagagtgctgcaagtattgattttgggattacaaatcaattcttaaagtaggtaaattcgcaaatacagaatccacaaataatgagccatttgaaatgataaaaatgtattgaaacagtgctgctcttagaaagaacttggtgctcttgtttgactaatcattattttactattcctcttgtgttcaagtcagaagaggtaaaccttaggatcttctctgtattattagagaatcgggcagcatagagaatagggcatttctatgtacagtgcttaaatattttctactgatgggaaaataccttatgataaaaggaggctgggataattattttatgctattttataaccagagcatgctttgactcacaacaggcattagtttcttcaccagtctctgaaacctccataagagaagtttaacaggtataaacagtgattaaccactctctcgtttgctttaaacaaacaatgtaattgaacagagtacataacccttcacttgctcttagcaaacttccagaggttcagaactgcctggaccatggcaattcatgggagacggttttagtgattgttttctttttctttctctttttctcactatatttcagcatagcattataaaatatcgtattgataaatgctttgttttatatttattaccaacagtaactataacctttcttttgaaacagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgtaagtattttcatggacaacccatccagtggcttagcaattttatttgaaaccaaaagaggccagacatagtagctaacacctgtaatcccaatgatttgggaggccgaggtgggaggatcattggaggacaggaattcaagaccagcctaggaaacacagcaggaccccactgctacaaaaacactttttaaaaattagccaggccttgtggcacacatctgtagccccagttatccaggaggctgaggcgggaggacccctgcgggccaggagtttgaggttacagtgagctataaggcaggtatgttggtctgcctttatgttgggagggaaaagcagtggtcttcgctaaactcctgtcccttccggcgctctccatccccacactggtgcggccactcctccggtttgtgtacacaacgcttctgaagccaaagctgtctcagcatactgtgggtgcacacagtccagcttctgtgtcccctcaggccaggctctcccactccaactgggttcacttgcagccttcatacctttcaaaaacacatagcttttttattatatgtagctggacaaagaaaagggaggacgaaggcacaaagagtcaggcttttggctttccacagacagcgagggggcacc

SEQ ID NO: 23088 - DNA, 733 bp, Homo sapiens
  ENST00000545752
tcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagagtcacaccaagcctaggctggtcttgaactcatgggctcaagccttgggcacctaaagtgttgggattacagatgtgagccactgcacccagctagaaccttccttctgaaatgtttgtcttcttctcagtcgtcgtgggatctggaatggtagaaatttaagaagaagaaaaaaaggcctctgctttccaatagctttcgcctggccagagtccaggcttctgagaatttcaatttaatctgtggtggggacaaaggatcattataaactaattatcacttca

SEQ ID NO: 23089 - DNA, 3317 bp, Homo sapiens
  ENST00000428465
ctggagggtgtttttaagttcttgcagtgacaagttgtcacattttctttttgcttcatccagatgcatgaatcaaagcaactgaagtctgaaagggaatgaaatgccatgagccagtatctgtaacctgcgggtgacaactcgagagcaacaagtgactgggtttaagatgatctccttttaaaggcgtctttaaagcaaaaggaagcatgtgtgttagggatccacgcgcatgtgatgaaccacatagagcagtgaagtggtgcaaatggaaaattcagtagccagtacatggggcgaggaggtagtgagatggcacgagggaacagcacatgcgtgaatgcaaaggcgtacgccacaacacccggctcatttttgtattttttgtagagacagagtttcaccaggttgtgcaggctggtctctagttcctgggttcaagcagttctcctgtcccagcctcccaaaatgctgagatggcaaggtgtgagtcaccgttcctgaccatcatctctcaaaaaaaaaaaaaaaaaaaaggcatgcatgatggctcactcctgcatccctacactttgggaggcagctgtgctgcagcctgggtgatagagcgagattctgtctcttaaagaaaaaaaatttaagtcttccaatccctgaatatggaaagtctttccatttacttatgttttctttagttttttttttttttacaatattttgtagcttttagagcacaaatcttgcatttttgttaaattgattcctaagtactttattcttcttaatcctattataattggaattgttttattaatttattataattattgtgctgttcactgctagtgtgtaaagaaatacaatagtttgtttttttttttttgagttagagttttgcacttgtcacccaggctggagtgtaatggcgccatctcagctcactacagcctccacctccccagttcaagcgattctcctgcctcagccccccgagtagctgggactataggcatacgctaccacgccgggctaatttcgtatttttagtggagacagattttcaccgtgttggccaggctggtcttgaactcctgacctcaggtgatctacccaccttggcctcccagagtgctggaattacaagcctgagccaccatgcccggcctcaattgattttttttttaagacagggtctcactttgtgtcccaggctggagtgcagtggcatgatcatgggctcactgcagcctcgaacttgtgggctcaagcagtcctcccacctcagccccctgagtagctggaaccataggtgcatgccacatgcctgattaattttttgttttctgtagaagcagggtcttttaatatgttgcccaagctggtctcgaactcctggcctcaagcaatcctccagcctcagcctcccaaagtgatgggattacaggggtgagccactgcacctggcctataattgatgtttatattattgatcttataccctgcaaccttgctgaagttgtttaccagttctaatagtttttagtgtaatatatatatatatatatatatatatatatatatatatatatatatatatatatatgattgtgttatctgcaaatagagatagttttgcttctcccattcaattctgggtgccttttatcttcttttcctgcctaatttccctggctagaacctccaggacagtgtggaatggaagtggtgccaggtggctcatgcctgtaatcccagcacattgggagaccaaggtgggcagattgcttgagcccaggagtttgagaccagcctgggcaacatggtgaaaccccgtctctaaaaaaaaatacaaaaattagccaggcatggtcaagcatgcctatagtcccaggaactctggaggctgaggtgagaggatcgcctgaacctgagaggtcaaggctacagtgagcagaggttgcctcactgcactccagtctgggtcaaagagtgagaccctgtatcaaaaaaaaaaaaaaaaaaaaaaaaaaaaagggggaagtggtgagagtggacatccttgtctttttttctgatcttaggaggagaaagcatttagtccttcatcattaagtatgatgttagctgtgggtttttcacacatgcccgttattgggttgaggaagcttctttctattcctagtttgttgagtgtttttaccatgtaaagttgttagattttgttaaatgctttttttctatgtctgtttagatgatcatgtggtttctgtcctttattctgttaataataatgtattatattaattgaggttgacatgttaaaccaaccttgcattcttgggataaatcccacttgatcatggtgcacaatcattttgtatgctcctggatttaatttcttgtattttctggaggatttttccatctaaaataattggaaagtattcctttttcctctatttttgtgcagtttgtggaaaattagtattctttttttttccccccgccgagacagagtttcactctgttgcccaggctggagtgcagtggcacgttcttggctcactgtaacctcaacttccagggttcaagtgattctcatactgtgccaggctaatttttgtatttttagtagagacagggtttcaccatgttggccaggctggtctcaaactcctggcctcaagtgatcctttggccacggcctcccaaagtgctaggattacaggcatgagccgctgcaccagccctactgtccaatttttagaaatctatcctggtgccttttctatttactgtggtcttttttttttccccatctttcccctagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtg

SEQ ID NO: 23090 - DNA, 492 bp, Homo sapiens
  ENST00000545988
ctgcacataacaaagcatgtctgttgggaatcccacatgaataagttatgaaaagaacagtgagtggtggcttttgttcccgcgctctgtccgtccttttgtttcttctgggcttattttccctttgttccactgacctgtcatcttgccggcttgggtgggtgaatattggccacccgtagaggatccagtttgacagctgtttcaggagaataggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaa

SEQ ID NO: 23091 - DNA, 1534 bp, Homo sapiens
  ENST00000219454
gacaggccactcccggccacgtctccaagcaagccggtgccccctcctcctgctgccaccgcccactgagctgcctgggctgcagacgccctggttggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgag

SEQ ID NO: 23092 - DNA, 1319 bp, Homo sapiens
  ENST00000568638
gaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaat

SEQ ID NO: 23093 - DNA, 549 bp, Homo sapiens
  ENST00000613603
gtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcagcctgtgtgggtgggagtcagccttgaggagaggcgatccctagacactgccttctcctgtaagtgctcccccaaaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgccttacttttgccttgttacaaaagtatgcttgctcctgaaagacagcatctcatttcggaaccccaggatttaaacggagcattccgtctccctgatcagtaccaaatgtttgtgaaatacacttatgcattc

SEQ ID NO: 23094 - DNA, 4148 bp, Homo sapiens
  ENST00000567056
gagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttactttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactcgcttgaacccggaaggcagaggttgcaatgagccaagattgcgccattgcactccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcattttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgaagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccctgggggtgggggaggtaccaggaggcagagggcaatttctggaaggaacagcatgcaggtcgggggcctggaggcctaggaggtgcgagcgggcacccttgcacacctgcggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtgtatttgtgcgtctgacttgcttgtgtaaatgtctgtgtccccatgcgactgtagggctgagtgtgtgtttcagggtgtatccgtgaacatgtctatatggatgttgctgagcctgtgagagtatgtttgggatcaggtgagcttggactgcctgtgtttgtgtgcgtgtttgtgggtgtgcacgtgtgccacatgccgctgagtgagacccagggcctagcctggaacctggggtacagaggcgaggccgcctctctgggtgaggtgcgttccctgcacccgtcccgggagtctgccttctagaccctagcatgtgcacctgtcctgggagtcggccttctagaccccagcgtgtgtccctcctgcagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataa

SEQ ID NO: 23095 - DNA, 4177 bp, Homo sapiens
  ENST00000622779
aagcatgcatccatccatccattcctccatcgatctattcatccatctgttcattcttccatctatccatctatatattcatctatcttttcatctacccatctattattttatccacccttctattcctttatccctccatccaaccatccttatatccactcatctatttgcccgtacatccattcacccaaccatccatccatctgcccattcatccattcatgcacatatccttgcattcattcatctatctcttctttcatccattcatacatccatccatccacccatccacccatctacccatccatccattcacctatgtatccattcatccatccacccatatatccatctatctattcagccatccagccagccactatccatccatctatccatccatccatatatccatccgtccatccacccacccatctatccatccatccatccatccatccattcatctacccatctatccatctatccacccacccatatatccatgcatccatccatccatcatttatccattcacccattcacccatccatccatccatcatttatccattcacccatccatccatccattctcccatccatctgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgagaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactgagtgacctcagctgggggagggaggagagggccaggtcaccaggcttcatttggcagttcctggtgagccacggggggcattagagcaggaatagatacatctaccccaacagagctgtgttcttttcacagaaggtgactcaaagaatgtggcagaacctggaaggggacaacagaagcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaataagctatccatgatgttaaatgaggacctactgcaatttcaaggcaggaacgtaggagaactttgtgtgtgatcagaagcagaagcaattctgtatccctctgaatcaaaaatccaagaccagactaggtcgcaactttccttttcattcctttgccttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcgtaggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatctcaacattttgggagaccgaagcaggcatatggtataatcccaggagttcaagcccagcctggcctggccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaat

SEQ ID NO: 23096 - DNA, 3255 bp, Homo sapiens
  ENST00000503569
cgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctcca

SEQ ID NO: 23097 - DNA, 587 bp, Homo sapiens
  ENST00000506588
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtgaggactgcggtgccggcagggacttcgggacgcggcccccggcacaacaggcctggccacgagctccacagcccacagagaagtgtcggtgcctgagat

SEQ ID NO: 23098 - DNA, 3640 bp, Homo sapiens
  ENST00000226760
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 23099 - DNA, 3655 bp, Homo sapiens
  ENST00000507765
cgtaaaagcagcatggacaacatgtaaatgaatggttatggttgtatttcaataaaactttatttgcaaaaacaggcagtgggccagtgctaacccttggttagctggcgtctctccagccctggctttctatggtcccctgactgttttgagaggtgtaaaggacccagtcatggttctgatttccatgcattgatggtgagccttggcaggcaggagcaactcaaggaagagaacctgtaccagtaccagtcggagcccgtgtctccctcgccgtgtggatggggtggccacaccttcctcaccgtgttttgaggagcgagtggccggaggctcagtagggcctagcctagtggacatgcctggtgtgaccccatttctgccccttccttcctggcctgggtgacaaagggaagtgggtgaaaggaggtgggctggcagggagcatggggtgggagagggtcggagaatctggaggctgactggtgtctggcttgcaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 23100 - DNA, 755 bp, Homo sapiens
  ENST00000506362
agcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagttgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttc

SEQ ID NO: 23101 - DNA, 570 bp, Homo sapiens
  ENST00000513395
gcagagagggacacttggggtgggggacagcacacccaggggccgggggccaggagtggaggctggcacttggcaaacctgcccccttcctcctcacccagcctggtcctcaaccctcaggccgcccagggaagggtttcctccacctgaacccactcagctcctttcttagcttggccccacgccaccgtccccagcccattgctctgtgtgagggtggcagtggggctgcagtgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcacca

SEQ ID NO: 23102 - DNA, 2238 bp, Homo sapiens
  ENST00000286574
gccccactcctcgctcgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 23103 - DNA, 429 bp, Homo sapiens
  ENST00000543094
ggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatag

SEQ ID NO: 23104 - DNA, 568 bp, Homo sapiens
  ENST00000546001
gtactgaaggcagatgcttgtgaacagaaatgacccacactaattctttggttttctttttgcttgaaacttctgatttagatgatttcaagtctacctggtttgatcgttttattattttaaaaaccaggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagac

SEQ ID NO: 23105 - DNA, 624 bp, Homo sapiens
  ENST00000592645
agaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgggacaggaggaactctttaacttcttttaaatgcagtcatttcacccttaaaaggagaggaaggggattgggccacagacttatccatggactcgtctgctctgagatctggaaaacgacctaactttggtctaaatctgtgctcctcaaggcattgtttgatagaaatgtaggatttcaggatctactcgagccctactgagacggaatccggattctcacaagatcccaggtgatttgtttgcatattaaagatggagaccagtgagtacactggtttgtggaagg

SEQ ID NO: 23106 - DNA, 1832 bp, Homo sapiens
  ENST00000262139
atggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgc

SEQ ID NO: 23107 - DNA, 1804 bp, Homo sapiens
  ENST00000589459
cccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacaggcaatcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttgg

SEQ ID NO: 23108 - DNA, 1886 bp, Homo sapiens
  ENST00000589316
cccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacaggcaatcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttg

SEQ ID NO: 23109 - DNA, 494 bp, Homo sapiens
  ENST00000585393
cgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttat

SEQ ID NO: 23110 - DNA, 1575 bp, Homo sapiens
  ENST00000546360
gggctgctgaggtggctgtcgccggctccgagctgcggcttcccgggccgagcccccgatggaggccgaggccgcggacgctcccccgggcggggttgagtcggcgctcagctgcttctctttcaaccaggactgcacatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaa

SEQ ID NO: 23111 - DNA, 685 bp, Homo sapiens
  ENST00000590402
gcctggccaacatggtgaaacccagtctctactaaaaatacaaaaattagccaggcgctgtggtgggtgcctgtagtcgcagctactcgggaggctgaggcaggagaatcgcttgaacccaggaggcggaggttgcagtgagccgagattgcgccactgcactccagcctgggcaatagagcaagaccctgcctcaaaaataaataaataacccacagagctgagcacaggcttcttcatgcttttcctttggaaggtgtcctagatatatgatgatttcttttttctttcacctcctcttgattgtcacaagtagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccataggatatt

SEQ ID NO: 23112 - DNA, 742 bp, Homo sapiens
  ENST00000591744
gtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccatagga

SEQ ID NO: 23113 - DNA, 829 bp, Homo sapiens
  ENST00000587731
ggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacaggtgaagagactgcttttcaaaagacagcctttcgagagctggtcgtgtagagttgtcccttcgccaagaacgacaagcttcagtgcccttgcattgatttgttcttcactggcagtctcagtggcaaacctctagtgggcaagtgctctgcaccgggctctgtgtcaggtgccctcagcatgtggtaatcatctggaaaagtgccaggattaataacacacaagatggtctccccctcagcctatgctcctaacacagccctgagctcacagtgggtgttcaaaaatattccctgccaccaggtgtggcggctcacacctgtaatcccggcactttgggaggccgaagcgggtggatggcttgagtccaggtgttcaagaccagcctgggcaacatggtgaaaccccatctataccaaaaacaaatacaaaaattagccggttgtggtggcacacacctgtagtcccagctactcaggaggctgaggtgggagaatcacctgagcctggagaggttgaggcagtgagccatgatcacaccattgcactccagcctggacaacagagtgagaccctgtctcaaaa

SEQ ID NO: 23114 - DNA, 828 bp, Homo sapiens
  ENST00000591494
cacgaaccaagatctaacagttctcggaaccaagatctaacgtcggaaccaagatgagcatcggttcattggaaccaatatctaagagttctcccttcctttacatttcttctccgacaagaatgatttgaaacagaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaa

SEQ ID NO: 23115 - DNA, 780 bp, Homo sapiens
  ENST00000586815
gaccggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaagtatgtgacaatcagctctctagtgttcagtatggattcacaattcctctgcgcctccagtaacacc

SEQ ID NO: 23116 - DNA, 2037 bp, Homo sapiens
  ENST00000354777
gtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattg

SEQ ID NO: 23117 - DNA, 2748 bp, Homo sapiens
  ENST00000262348
ctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcata

SEQ ID NO: 23118 - DNA, 2332 bp, Homo sapiens
  ENST00000370976
tccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaa

SEQ ID NO: 23119 - DNA, 745 bp, Homo sapiens
  ENST00000498615
gggcaaggtaaggaccactgactgtgcctgacagaaagctagagaaccttcagttgaccttaatttacaccgaaatgattcagattaaaagatggagtcttacatggcccttcatgtttcccacatgtagaagagacttggttttcatgttggttggttcctttattggtgttatgtttcttctgtttcttctctgtttcaattgaatatcaccatcctttctccgcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattg

SEQ ID NO: 23120 - DNA, 1041 bp, Homo sapiens
  ENST00000491811
tttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcagtttatggaccccttgaattctatccaaggacacccaagaggaccccaagtttggagcctctagagccctgttgttggctctgccactggggagtgttagtgttgctagctctgctgaggttgaaatgaacgtggaaaaaataaactgatacacatatatgtctttgtaagttctgttcaccacatctgctttgacctacaacactgctgtgtttatatcaggttgtttataaaaccttggaaacttcgctttccactcc

SEQ ID NO: 23121 - DNA, 747 bp, Homo sapiens
  ENST00000497187
aatgggagaagtcatcaagctgggttagggctgtgctcccagggctggcttcggaggcaggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtg

SEQ ID NO: 23122 - DNA, 600 bp, Homo sapiens
  ENST00000534713
aaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgc

SEQ ID NO: 23123 - DNA, 524 bp, Homo sapiens
  ENST00000533537
ggtcgtctttgctaggggctgagggtttgcaatttggggtcccgaccttcgcgccctctgctttcccgccgcactccaccccacgctctgccgtggacaggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaa

SEQ ID NO: 23124 - DNA, 1056 bp, Homo sapiens
  ENST00000530486
agaaagaagtcgagctgagactttattccgcatctctgtgttttgacttaggcatctattgggtccttttaaaaaaaattctcctcctctttcctaaagagagttctagcagttgggggtggggtggggaccatttcctaaagtcaacgcgtaagttaaaggtctgcaaggcggtccaccggtgatttaaatctcgcacttcggaaaccagaaaaggaaacctgtgagaagctgggcagggggaacccgcttaacatcaacagcaacccctaaatggcatcagaccttggagagacaggttgcaggccagactcgggagccaggcgccagcacccgccagagctctgagccccgaactgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaa

SEQ ID NO: 23125 - DNA, 572 bp, Homo sapiens
  ENST00000370973
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggagga

SEQ ID NO: 23126 - DNA, 555 bp, Homo sapiens
  ENST00000471243
aacgaacagtggtctgatttggctggagagcaagtttcctcaaggggcgccgtggggaatttagctggctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaa

SEQ ID NO: 23127 - DNA, 779 bp, Homo sapiens
  ENST00000491076
aatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgcatacccataaatgagactattccaaacataaactctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggc

SEQ ID NO: 23128 - DNA, 570 bp, Homo sapiens
  ENST00000527864
ggttcccttccaatcagctccgggagggcaacgtaatcgactttattaggaacaacagaagagtcggggaactgtgcccggcgcaaacccggagctctgttacaaggctgagatacttgcacgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcacaatgaacaggacttcagagaagagtttgggagtgtggcaaacaagatcctattacacatgatggcttcctgcttatcagagattcacctgtaacaatattacttcatatgagaaaatgcagaagtctccatggacgtttccctggcttaccgtgatgacgcgtttgctgagtg

SEQ ID NO: 23129 - DNA, 700 bp, Homo sapiens
  ENST00000370971
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagttaagtgtactctcctctcatccctttcttccctttgagcattgccctctttgggttctttttgagccaattctaataaaagtaaaaatggtaata

SEQ ID NO: 23130 - DNA, 1703 bp, Homo sapiens
  ENST00000233948
tccgcaggagacacaggcgctggctgccccgtccgctctccgcctccgccgcgccctcctcgcccgggatgggcccccccgccgccgccggatccctcgcctcccggccgccgccgttgcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccacca

SEQ ID NO: 23131 - DNA, 408 bp, Homo sapiens
  ENST00000486233
cgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctct

SEQ ID NO: 23132 - DNA, 4041 bp, Homo sapiens
  ENST00000285018
gaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcggtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatttttttttttttttttgctgtttgctgctacttatccagaaatttaagctggtccagatttggagacgttttttccagagtatgttttccatccttttgccctccccagttcaaacttcaccattagaaaaatccagtttggaataaatagagaggaaaaataataaattcccagcagtttccatctttcggaaagtgagccaccggataagagagaatattttgtaagagactatttttatatgaatattttatttatatcgagtctactgtatcattccacggcctgtgcttcttcttaattctggtactcacttaggggtaaggaggggcgatgcctggttgtggcgtcaggccccatggggccccttgcacagctggattcttgagttctgtttgccaagtgggcacaagctgcccctggatgcctggggttgaggcatcatctcatccatgttagccgggaaagaaatcaaatccccagcctcagcctgttaagctcaggcctttcaagcagggccactgagtggtagcttcgaaatgagtcactgtggtgggtggtcatcgtgcccctcacagggacttgaccgtcatcctgcagcagaggccagttcagggagccccacacctcaccaagacactagccattgcctgcgtgtcctggaaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagaccacagcacagccccatggccccacctgctgggagcccttcagtatctaggctgtgtctgactcctcagtgtccacactgagcctggatcacagcatgggcaaataaaagtgactggatggttgcatggtttcttcccttggacatttttttccatttttcttttacttgggtgtctggaggagtgggcatgtgaaggggccatggagtgaatggatggagggatggatgaatgtgtgagtaggtaggtaggtgaatgggtagatgtgtggatggataagtaggtgggtgggtgaatggataaatggatggatgggtagatggatggatgaagggataaacagatgggtggatggattgataagtgagcggatgaatggatgaatagctaggaaagtgggtgggtggatgagggtgggttgatgaggtaggtacacctacagataggtaagtgagcagtttcttgggagtccacaggtcacattttatctttgctttggaaaacctagcagatctgccatgatcaggatggcttcccgaccttgcaacccttctgcttctgacctccttggcacctgggaatgggggagattctgaccagcctccccagatgagtgttcaatgatagttacataaacacagtctcagaagagtcatccctgtgtcctccctcactgtgggttcccagctctggggcctgccctctctcgggtgccctgttcagctgtgctctgagccccagtttctccacctgtgaaatcagaataacacctacctcacagggctgttgtgaggatcctcccagtaatgactgtatggcactttgagttgcaaagcaatggatgaa

SEQ ID NO: 23133 - DNA, 401 bp, Homo sapiens
  ENST00000489346
ggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtgggtgactgcctgggctgagggtcccatgtctggggatccccacactctgcaaaaaggactccatcattttacccatctagggctgtgagagtgcaacacatgtctggtgagctggtgaatgcttagaaggatggatttgaagacctttccagtgagagagacagaagcaaggggcgggccagctccattttctctctgccatttcttaacaatacgccatcttgcccaagcaaaa

SEQ ID NO: 23134 - DNA, 531 bp, Homo sapiens
  ENST00000497808
ggaaaggtcacatgagctgctgtttgtggcagcacccaccatactgccttggcacatagtagggacactgcccaagtttactgatgcatttgatgcatatttggggggcacctgccatgtaataggtactcacccggagccacatctttgaagtgccacaatccatttattcagcagtcatttagtgaaccagcagacagcctccctgccctcagggagctcatcctctcaggaggaagacaagtgatcaattccttgagggcagggcattgcctgtcaggtgcacagctgtctcctagcatgtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggg

SEQ ID NO: 23135 - DNA, 3919 bp, Homo sapiens
  ENST00000339464
attggccgccgcggcgctcggcgaggcgctcacggcctcaggcggctgcgcctagtgcaggctgcacccgcccgccagccgcgcccgggcccccggcccgcgcttgcaggggtccacggtcgctcaaccgggcttcgaggtcgcggcccccagcctgggtcaattccccgggctcacgcggcggtggcggcggcggcatcccgggctcaccatggtggcagcgcgcgccgagtgcccgcgcgtcgccggccgcccgagccgcagcgcgggctgagcgcagtctgcccgcagccccctggcccctgcccggccctgccgggcccgcgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagccatggacaggctcctccatgccgtctttccttcttttgaaaatcctatcaatggctgggcgcggtggctcacacctgtaatcccagcactttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctcccggcctggcacctccagtttacagagacccccttccccctggagccagcctgacccctgggacagtgctgccgcgggggtcaggcaggtggtgagtggtcagggatgtttgtcccacttgacagatgggaactctgaggcccagagtggcacaaggacctaccagagaccctgcagctgtgactggaggcttccacctttctcctgcccagcctggggctctggacctgggagaacacatcaggatgcccggggtggcagtaggtagctcccatgccttgaggcacttggctgctccctccaccccctgacagcctcattggggcctgcactcccctcggtgcctttgaggcttcgcctagccctgtcctggtccttttaccctgaccccagtgctgagaaaatctggatccagagctggacatgtcctttctggatgctcccacccctgtctctgaggagcatgagtgacagagggaggaacttgtccgaggccagagaggatggtctgcagctggctcctggtgcacccccactgcccacggcctggcccccatttagggtgtgttctcttggaagcccgtaggaatgtgttcttgagcagccgacaagccaagggcctgggctcagcctggggcaagtgggtccctcctgggctctggccctgtggtccagcccatgtgcctctaaccatgcctggacgctctgagtctccgggccaccgtgaatgccccaccctcagcctggccccatccccttaccttccccaagtcccagaacacacctgagtccataggcccggcagcctctgcaaggaacctggttaacttatgttgttatatagcgtcgaaatgtctatagtgtctttaaattattgtgacctacactgggtaccggagagggggatggctgcggcccccatccctcatcccccatcccatcccatccctcatctcatccctcatcccatcccccatcccatccctgaccccatcccccatcccatccctcatccctattccccatacccaccccccatcccatcccccatctcccgaaccaggctcctcctgcttcaacagacccttggggcccctgatgccaccgagacactcgcactgtcccttggctgccgggcaccccactgagcccctgcccaccccaaagtctgccagcaacaggccctttgcctgggtgagacgggggtcagggtggcccagatgggggtgatggcgaccaaggtgctgcgtccccacccttctgacggcagcctcccctggaggggagtgctcggcccaataaaagctggaatcggaaaagtga

SEQ ID NO: 23136 - DNA, 2285 bp, Homo sapiens
  ENST00000409496
gggtgtcccagccaaggcaacttgggcaagccctggaggcggctcccaccgcacgctccggtcagcctcccctttaaaaaaacccgccgggggaggaggcggatgtaggggcggcccgtccaatggcagctgcgcgcctcgggagacttggagaagtgagccagagcgagcgacagagccggttcgcaccgacagacggacggaggtccagaccgcagccaaggcgcgcccgctgcccccggccgggtccccgccccgcactccagccccagctcccgccgctgccccagacccagcgccatgcgcggccctagcggcggggcacgggcgacaactgcgcccgggcccacgagacccggcccctagcgcccagcgccgccgccctgcatcggggagctccgcggggaccccggcctcagctggcccaggcgcccggcccgcggagcctgttcagccccgccaggcacgccggcccaccatgcttctactgtcgccgcgcagcgcgctcgtctccgtctattgcccgcagatctttctcctcctgtccagcggcagctacttagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 23137 - DNA, 2202 bp, Homo sapiens
  ENST00000410089
ctggcgcggcccggcgggcgggcgcccggcgagccgcgctagctgctctctgcggtagctgctccgagtcgtatttccacattcctgaacccagccgagtccttacctgttgagccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacaggcaaggcggtgaacagacccgcgggaggggcaggtgcaggtaccactggtgggagacgcggcttcccaggcggagaggtggaagcaggcgctgggaatcgtctctccatcaccctccatcccatgtctgccccgccattttacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 23138 - DNA, 714 bp, Homo sapiens
  ENST00000410058
cgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaagggcctacttggacaacccagggtgacctcctctccgttgtttccttgaccacatctgtaaaggccctacttccaaataaagtcacttgccgag

SEQ ID NO: 23139 - DNA, 521 bp, Homo sapiens
  ENST00000428540
gccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagc

SEQ ID NO: 23140 - DNA, 1821 bp, Homo sapiens
  ENST00000563763
tttccacactgtggaaggtttgttcttttgctctttgcaataactcttgctgctgctcactgtttgggtccacattgcttttatgagctgtaacactcgccgcgaaggtctacagcttcagtcctgaagccggcgagaccaccaacccaccaggaggaacaaacaacttcagacgcgctgccttaagagctgtaacactcaccgcgaaggtctgcagcttcactcctgaagccagcgagaccacgaacccatcaggaggaacgaacaactccagacgcgccgccttaagagctgcaacactcaccgcgaaggtccgtagcttcactcctgagccagcgagaccacgaacccaccaaaaggaagaaactccggacacatcctaacatcagaaggaacaaactccggacacgccacctttaagaactgtaacactcaccgcgaaggtccacggcttcattctttaagtcagtgagactgagaacccgccaattccggacacacagctacagccaagcctctttgcttctctgggccagcctctctggagctgaatcgtggctggctggatttgaggagcctgcatgggcgcactctctctttctgaatcccagctagggctctcctggctgtaattactaagactcagctgctgggaatttccacgcctcctacctctctacagggcagtccctccatattaggaaacccactggcacgctccgccgttatcttcgcaagacttccgttgttgcctcaagttgcagattgccttttaacagagaagaaagtgacaggaatgtgctggcactgatgacacagtaatgaccaaggtcttcagtgttttggccatctccctacctgatcaccctgaagcaacacccacaagcagacaagctctgcccagctacattgagatcccagaaccagagccactagcaatctcaccctaagaggaagagaaggagagccaggcatggctgtctgcagtgtgcctctcacggatacttcttttacctggcggacagcccagcgcctagttgtctgacccgtgatcaagatgtccttcacacggaaaacttgtttattctgacaaatgccttggtggttgctgtgtccagtgaatgcctgcctgaccatcgctcggagctgggagcttgtgttatccactgcgtcccggggaaaacctgctggggcagcccccggttcttcctttcttctctgcaactggggttctctgtgttcagggattacccaaaccacggctttctttggagaccagtgatggcaaagcgttctcttctgctcctgccaagtcgccctcactcagctcaaggcctctggcattccttggagacttctgctcactgctgttggaggaagatgctgattcaggccagattccatcttggggtgcgtgcccttggtcttcctctgccccacacgctccttccgcagctctgtgcatggttgctcctgcctgtcattcaggctttggctcagacagcacttactcaagagaacttttttggtagacgcatagcttttaaattttttttaaattttttaattttttaaacgtagtattttgattcaggggatacatgtgcatgttcgtcacagggtatattgtgtgatgctgaggttttggcttctattgatcctgtcacccaaagagtgaacatagtccccagcaggaaattttttaacccttgcccccatccctccctctccccttttggagtctcctgtatctgttattcccatctttatgtcatgtgtactcaatgtttagctcccaattataagtgagaatttgtggga

SEQ ID NO: 23141 - DNA, 759 bp, Homo sapiens
  ENST00000573619
ccatattaggaaacccactggcacgctccgccgttatcttcgcaagacttccgttgttgcctcaagttgcagattgccttttaacagagaagaaagtgacaggaatgtgctggcactgatgacacagtaatgaccaaggtaaacaaggacctgctctagcctgacaggctggtcttcagtgttttggccatctccctacctgatcaccctgaagcaacacccacaagcagacaagctctgcccagtgagacagcacagaaaagcctccccgggatgtctggcagctcctacttggttccactggaaagaaaataagaggtcattattcacaaacaagatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacaggg

SEQ ID NO: 23142 - DNA, 523 bp, Homo sapiens
  ENST00000572764
gtcaggacccatggctggccagtccatatccattgtcctcgtaggagactggacctcagagtggggcaggacttcccacagtcctgcagcaaaaggcagtggcagaaccagtcttggggcctcgcctcctggctgacccaggtgctaaatgatccctcactaggcactgggactgtcagctccctgaggaccaggagttgagttaaggggggtcagaccagcaccaggacccaaagacagtctaatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctg

SEQ ID NO: 23143 - DNA, 5884 bp, Homo sapiens
  ENST00000574946
atgaaactcccttttaggaagacggagtaagaggcaccaccacctgctcctgctgcctctgctgtcctcagcttctgggagcatcttagcagccagctccggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggacgttgagatatcctgaccctctgcttcctagcctgatgatggggaacccagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcggcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 23144 - DNA, 1573 bp, Homo sapiens
  ENST00000573634
ttttaggaagacggagtaagaggcaccaccacctgctcctgctgcctctgctgtcctcagcttctgggagcatcttagcagccagctccgggtgaggacagggtccaccggtgcacatggcagagcagggcagatgctgtgacttggcggctttgggggaacagggtggggctcctccctgggaaaaatctttaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctca

SEQ ID NO: 23145 - DNA, 1059 bp, Homo sapiens
  ENST00000576083
cgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcg

SEQ ID NO: 23146 - DNA, 2129 bp, Homo sapiens
  ENST00000574232
ggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccac

SEQ ID NO: 23147 - DNA, 677 bp, Homo sapiens
  ENST00000571973
actcttgttaactccatgcgtctgaaagccctcagctccgttaagctgtgttcctggaccgcctgggggcctgtgcctatgcactgctccatctctcccatgtttcaggcttcatccatggctctggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgc

SEQ ID NO: 23148 - DNA, 570 bp, Homo sapiens
  ENST00000576233
ttttacagatggggaagctgaggcccagcaaggttaagcaacctacccagtgtcacacagctggccagtaacaaagctgggatttaaacctggctttgtccagtgctcctgcaacacagctggtccttggataaagcaagcacaggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcc

SEQ ID NO: 23149 - DNA, 2168 bp, Homo sapiens
  ENST00000571494
ccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgca

SEQ ID NO: 23150 - DNA, 494 bp, Homo sapiens
  ENST00000576947
aagtgcaaattctcagattctcccggagttgcctagtcaggaactctggggtaggggccagcaggctttgtatttaacgctgtctccagctgaaaggaataaatccgcctcagagtgggtcccagtgtatccctcggaagttctttctttcctgaacattctcgcctctgtcggggagttagaaaagctgttcattctgcgtccagataaaagagctcgcctcctcttttatccccgtcgcacactgagacggggccagccaggcccgggctcgccctccacgccggtgagctccatcaaatggccagctggtcacagccatgcttccctttctgcaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgtt

SEQ ID NO: 23151 - DNA, 5819 bp, Homo sapiens
  ENST00000317744
ggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggacgttgagatatcctgaccctctgcttcctagcctgatgatggggaacccagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcggcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgttt

SEQ ID NO: 23152 - DNA, 2665 bp, Homo sapiens
  ENST00000539421
ggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgc

SEQ ID NO: 23153 - DNA, 4481 bp, Homo sapiens
  ENST00000547525
atccccggggcgggtgcccgcgcggggcctcgccgcggctcggggcacccgcagtgccgcccgcccgagcgccaggctcacaggagcccggctttcacttcctctcgcttccgcccgcctccctggctcgccggctggcgtcgccaccgcctcctcgtccccggccaccgctgtcgccgctgctgcaattcaaggcgcacactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 23154 - DNA, 554 bp, Homo sapiens
  ENST00000552195
tccctggctcgccggctggcgtcgccaccgcctcctcgtccccggccaccgctgtcgccgctgctgcaattcaaggcgcacactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcagtttatagtctactgaggtgattaaacagctggattaagagtttccatcccggagtcaaacagactgaaatcaaatccccatttcacctctaaccagctgtgtgaccttgggcaagtgacttcccttctctgggcttcagtgtacctgcttgtaaaataaaggtggcatccctgagtcctgatgcctgactggatggaggcccaccagcttctgttcc

SEQ ID NO: 23155 - DNA, 766 bp, Homo sapiens
  ENST00000550529
ggctggcgtcgccaccgcctcctcgtccccggccaccgctgtcgccgctgctgcaattcaaggcgcacactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcagatgttcgcttgtgtgttctccactgcccaaacccaggtggttattctgcaacagctacaacttgagtaagaccaaaacacaactcaagtggactttctaaaaagagaataatttattttggctcccagacatcaaaattcgcaagggattgcttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtg

SEQ ID NO: 23156 - DNA, 552 bp, Homo sapiens
  ENST00000551106
acactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggttccgcctcccatgccccaggcactcttctcaggacatcacgtacactggctcatgtgatgttctccacaaccctaagaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgct

SEQ ID NO: 23157 - DNA, 569 bp, Homo sapiens
  ENST00000551638
agcagctgggaaggcgcccacagagcgggcgcgccaagcgggacgcgggagtcgcagagagggaccccgggcgcctgctgagctcagctggcagagtttgcaagtggcggagacccttcagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcagg

SEQ ID NO: 23158 - DNA, 535 bp, Homo sapiens
  ENST00000546401
agtccccgccctctctctgctttctcataaaatctctgctggaccagccactcctagtggggagcccagggtggtctgggagtgctgcatgcacccagctgctgtatcaccaggacatcaggaggtggaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctgg

SEQ ID NO: 23159 - DNA, 4710 bp, Homo sapiens
  ENST00000332082
tttctcataaaatctctgctggaccagccactcctagtggggagcccagggtggtctgggagtgctgcatgcacccagctgctgtatcaccaggacatcaggaggtggagatgttcgcttgtgtgttctccactgcccaaacccaggtggttattctgcaacagctacaacttgagtaagaccaaaacacaactcaagtggactttctaaaaagagaataatttattttggctcccagacatcaaaattcgcaagggattgcttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaccatgtggtagagtgttgtgtaagacaggttcacaaatgggatgttttcctagtgtgtgtgtgtgtgtgtgtgtgtgtgtatgagagagagagagagagacaacagagacagagagaggcagagaggcatagagagacagagagagagacaagaaacagagatagacagaaaatgttcggggtggcaggcgggttggtgtataactgctttgtgcctgtgtgactctggcatagctgctcagggagaattacgtgcctctgtgtgtaaaattgcctttgtgttctcctgcctttctatgttttgaaactgtatcccacaagttgccggtatgaccatcttatttgtaatgagtctgtgcaggtccttgtgtatggaattgcacccgtgtaaaggaggaaatggtcagtgtgcatgaaa

SEQ ID NO: 23160 - DNA, 565 bp, Homo sapiens
  ENST00000551057
actcctagtggggagcccagggtggtctgggagtgctgcatgcacccagctgctgtatcaccaggacatcaggaggtggagatgttcgcttgtgtgttctccactgcccaaacccaggtggttattctgcaacagctacaacttgagtaagaccaaaacacaactcaagtggactttctaaaaagagaataatttattttggctcccagacatcaaaattcgcaagggattgcttcagtttatagtctactgaggtgattaaacagctggattaagagtttccatcccggagtcaaacagactgaaatcaaatccccatttcacctctaaccagctgtgtgaccttgggcaagtgacttcccttctctgggcttcagtgtacctgcttgtaaaataaaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaaga

SEQ ID NO: 23161 - DNA, 543 bp, Homo sapiens
  ENST00000551734
ctcctagtggggagcccagggtggtctgggagtgctgcatgcacccagctgctgtatcaccaggacatcaggaggtggagtttatagtctactgaggtgattaaacagctggattaagagtttccatcccggagtcaaacagactgaaatcaaatccccatttcacctctaaccagctgtgtgaccttgggcaagtgacttcccttctctgggcttcagtgtacctgcttgtaaaataaaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacc

SEQ ID NO: 23162 - DNA, 454 bp, Homo sapiens
  ENST00000546811
agagttattccagctgaggagcaagggagctggggcatttatacaccaactcccatcagtcatatttgcagctgcttccaaatgttaatattctagcatgtcttgcctgccaaccacacaagcacaaaaagcattcaaggtgctggagaaacccctcagacaaccagatgaacattcagaatttaactctgtgggtggggcacatatggcatctgttacagatctaccaaactgaccaaaaaggaaaggactgacaacattaagtgttggtgtggatttggagcagcaggaatgctcaaactgtactggggaagttgtgactacagcaaccttggaaaaaaactggcatcttttaggataatcataagatgctcatacaaaaacaaaaacaaacagacaaaaactagcgctttcactcctaggtggcatccctgagtcctgatgcctgactgga

SEQ ID NO: 23163 - DNA, 3534 bp, Homo sapiens
  ENST00000549903
atggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaaggagccgtaccaggatctttgcaaatcttatttcgctcgatttgcacagcatctgtaggagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 23164 - DNA, 433 bp, Homo sapiens
  ENST00000547185
ggagaaggaggaagagcgagtgtttaataggaaccagctgtcatatcattgtagctataaatagtgcctgccattatcatccccattgcacagaggagaaaattgaagctcagagagatgaagcggcttgcccaaggtcacacagcttgtcaagagctaacagatgtggaaactgaggcttgaagaagggaagacacttgcccaaagctgcgcagctggtcagcagcaggaacggagtttaaatctgattcatctggcctgaatgctcagttctctaaggctgtctcctagagtccactggcatctacccatccaaccagcatgctagggaggaacccacaacccctacaattcataagattaacacaaatggacatttcagaaatctgggccagatggtttgggagaataaaccaccaatcaaggcagatgg

SEQ ID NO: 23165 - DNA, 574 bp, Homo sapiens
  ENST00000546629
gagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaaggtgaggagatggcagggagggcagggcaagaggttccctgggcttgggaaggtccccacttggagggtatgggaatactcctccttgagtatctactgtgtgccactcagctctcccaggcacactttttgagactcactgcatgcttggtacccccccaccttcctttatgccccacaaacatttcttaagtcatgtcctggatactccactagcatccattcaataattgac

SEQ ID NO: 23166 - DNA, 7130 bp, Homo sapiens
  ENST00000265293
ggggcagcgcggttacctgcaccgcccgagccgcacctggcggaggcagaagtcacaaacccggcgagctcagagcggtggagcggagaggagggacggcacccggctgcagggaggagggaggcggcagcggcagcggcggcgtggagggcgcagcgcgccgcgcggcggaggagggcagacggcggcggcggcggcgctcggctcgctctgcccggccggctgggcgcgcacccgggctcgcaccgcgccgctgcggacgcacatggcagcgtgagaggccggcggcgggaggagcgggcggcgccgggtcggggctgcagggccgcatggacagcggcgccaccccggccggcccctactagggccccccatctgcgggcgccaccccccggatcatggtgcctcggcggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccaggggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaaagaaaaatgcagactggctggcgcggtggctcatgcttgtaatcccagcactttgggaggctgaggcgggcagatcaactgagatcgggggttcgagaccagcctgatcaacatggagaaacctggtctctactaaaaatacataattagctgggcgtagtggcgcatacctgtaatcccagctacttgggtggccaaggcttgaacccaggaggcggaggttgcggtgagccgagatggcgccattgactccagcctgggcaacaagagcgtaactccatctcaaaaaaataataataataaaaataaaatgcagactgtcaggtcctctctagacccactgaactatcccgcccaccctgggacggtccccagtgccagtgttttacccatgttccctctgtaagtcttatgcacaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttataa

SEQ ID NO: 23167 - DNA, 3562 bp, Homo sapiens
  ENST00000521089
aagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacac

SEQ ID NO: 23168 - DNA, 599 bp, Homo sapiens
  ENST00000523043
accagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaagccttgccatgttgaaggacggcttccgcactgacagggggtctcactcagacctgtggtccagcagcagctctctggagagttcgagtttcccgctaccg

SEQ ID NO: 23169 - DNA, 562 bp, Homo sapiens
  ENST00000519859
gaagagaaagaaaggactggctgggttgtaggcagcagggccgagcagctgagggctaagtgcacagcaggccctagcaaatgcttctggaattgaattggtccaaggggagactccagctttagttcaacatgggctgtatccgaatccttctgaaatttgctgggattccatgagggagtcaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgcca

SEQ ID NO: 23170 - DNA, 3980 bp, Homo sapiens
  ENST00000393895
caggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaa

SEQ ID NO: 23171 - DNA, 476 bp, Homo sapiens
  ENST00000519659
cttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggtaattgggctggggctaggggcgggatggttccaaaaataataactactattgtagaatgcctgctctgtgcttagcttttcacacacttcgtcttctttaatcctcacaaagattatgaagatagttattatactttttatattttcatcctctctgaaattcagagaggaaatgactcaccc

SEQ ID NO: 23172 - DNA, 743 bp, Homo sapiens
  ENST00000517425
agccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaagactttcctgtcaatgtggccaggcaactcccagcaattcggagcttacacactaccagctcccccaggcgtccagcaaaacagcaagacatctgtatttggacagccacttcttgttctctctgaagaggaccactctgaaccttggatctgttccatcctgcaggaatgcctgtcttagatggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaac

SEQ ID NO: 23173 - DNA, 3408 bp, Homo sapiens
  ENST00000524228
caaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaag

SEQ ID NO: 23174 - DNA, 254 bp, Homo sapiens
  ENST00000517646
gagagttcgagtttcccgctaccgaaacagtacctggatttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaa

SEQ ID NO: 23175 - DNA, 2451 bp, Homo sapiens
  ENST00000624315
gatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggtggggctggggccccagggtgtgtaggacccttctctcactggcagtctgtcctcagcccccagatgggggaagaatgagggggctccgggcccctgggctccaccctgagcacgctcagttcagagatctctcaggttgccgacataggaaatcaggaaagatggtttgccatccagtgcgccagctaccctggaattttgcatggtgaatcatgctaccaaaaagtctgcttaggtgcaggtgttcaaaaatgtatcttctgactcaattaagccacataactctatataacttaaagcagtcattttccaactttttgacagtgatgcacattttatactgtaacctgatccaaggttcacaaaatagtgcatgctctttctacctctgatggtcctctgatgttttctcccttctgttgcattttgtttcatgcagtttgtgactcaccaaattgatttcaccccatgctaagtaaggggttgcagtttgcagtttgaaaaacactggtctggataggggttgcaaactggcatgcttataggagccaagcaggtcacagaaatgctagagacccacctggcagtggtctgtgttagaccagagtgcacagaccccactggtctaaagcaggtgctgtctctctgctccagcaaatgggagtgcaggcctcgggctgccagagctgcctgtacttcaaacaaaagagtcgttcagattttttatttttaaatattgggaactaatccagaagtttttttaaaaaaatatgcaaatcagcctcatctatgggcctgatataacctaaaagccaccggtttacattctttaatttagaccttattatagacattgtctttgtttatttccttcagtgttcccaccaacctcctcacccacattgcaccgaatgcaacactgcgttcaccataggctttacaaagctctccagcttcatgttcatttattcattctgttcatcagccaatgtttactcattcatttgagaaaccttttgctgcacagattgtgtgtgcaaggcaatttggggcactcagaaattaacaagacatggtccctgccccatgacctttaaatctattctagttattttcaccattttttggcaggagcctttattcagcaaggtccctgcccgtaaggagcttagaagtgaagctagagattttcaagtgtgtgtgtgtggggggggggggggggcgtgtgtgtgtgtgtgtgtgtgtgtgtgtgtgtgtgtggcatatgtggtgtgtgtgtgtttggaatatgagcaagggaattcctttttctagtgaaatcagaggcagaggcccagtctatgaagcaagtaaacgtgcctactgcctcagtggaagcagtcgggagtcctagagatgctgtctgtgctcactctgtcaccccatcatggggcttccagagagcctttgagctctaaggcacccagcttgcagtaccattctagcaactgagtaggccccacttgcacatggcatggtgccaggtggatcgggttccccaagttcttgcctggcctcccatggcttcagagacccccttgactcatcgatggtaggaatctctccgcactagttgcttagtcagaactgctaacagtgatgtccaaagcgtatccatttcctctcttccgttcttcattggcagcagcagctgattagccctgatccaccaccagttggtgggagaaggagaaggacagagcttgaataattggtgttctgcagcccttggaagcaccttgctagaagtcttctttagcaccacgactccattctgctttctctgggattttacgctttggggataaggcctgtgtctatatgcccgcatgcctttagtgttcgttgaaagaataaatggttagctggcctaggtagacccttactgggc

SEQ ID NO: 23176 - DNA, 611 bp, Homo sapiens
  ENST00000518334
ctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccag

SEQ ID NO: 23177 - DNA, 489 bp, Homo sapiens
  ENST00000524093
agactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctggacgctgtgtctgctctgttggaacagacagcagtggagctggagaagaggcaggagggcaggagcagcacacagacactggaagacagctggaggtatgaggagaccagtgagaatgaggcagta

SEQ ID NO: 23178 - DNA, 2077 bp, Homo sapiens
  ENST00000524038
tttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaa

SEQ ID NO: 23179 - DNA, 1015 bp, Homo sapiens
  ENST00000522140
atgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatga

SEQ ID NO: 23180 - DNA, 386 bp, Homo sapiens
  ENST00000521391
gtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcaggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttataa

SEQ ID NO: 23181 - DNA, 543 bp, Homo sapiens
  ENST00000518204
ttatcgttctgaatgaagtggatcccacatggagcaagagtgagggtgccgtccctacagtagccccctctgttgtgatagcgagttctccttgcccctttctggaggccccctccactgactcagggccttgcttgctttgcccagcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaa

SEQ ID NO: 23182 - DNA, 8826 bp, Homo sapiens
  ENST00000403733
ctgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaataagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaaagtccagcaaaccagcccagaaacagggcctccccaaactcccacctggggacaaagtctgggacgttctcatcccagaactcctgaaccgtcttgtgggcaacccaagagacgggaaccagggctgtgactcccgaggcccaggacagaattcctcccaggatcagcagtcgcctcttgagatctctctgactctctccaattctcaaacagtccaggccaaacccagagaccagcaggcccagaaatcccagcccatttgacagaaacattaagatcctggagaccctgagttcagcaggcaaagccaggaaggagtcaaagtccttgcattgcatccccacttcctcttggatgacacaggtttgccagagtcccatggtccagttttccatttcatttaagtccaggttgaggttcttccagtgtggcaggtagtttgtaagacaggataaaacccatcccagcaaagataatgaaactccagctagttgagctacagttctaaatactaaagccattataatgtcctgagagctttagccaaactaactcctgcccttcggttgctgtgaaaagaagtgtgacacttgtgttataacttatgaaactcagaaatatttcttcattgtgtatataggaggattcttgccagagttgctattgtttgattccatgttgaatgggtttcacaaaaggatagggaaataatgccgccaaccagtaatgccaaggtgtggccaagattgtgtttgtgtcctgtgggctggatttgacagaaagcagtttgtcactgaaatataattaagtgataatctcctttcattgtcaaggttaaaatggctttcatgttattcccaacctttctaacaaagaattaagtctaaatgcaaaatgtttaactgatggttttggttcaactcctcctgctttgtgtttcactaactgcacctgtcagattttcatctcttatagttctcacatttcaaatgtgcatgttatggtaatactgagtgttattttttaaaaataggtttaagaaaagtatttcttaaccaaataaatcaatcttatcagaaa

SEQ ID NO: 23183 - DNA, 604 bp, Homo sapiens
  ENST00000508614
gcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacagttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcag

SEQ ID NO: 23184 - DNA, 4887 bp, Homo sapiens
  ENST00000513834
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaa

SEQ ID NO: 23185 - DNA, 6356 bp, Homo sapiens
  ENST00000448232
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgttgggagctcaaagatgatgtgtttacacggcttacagtgaaacctttgctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacataga

SEQ ID NO: 23186 - DNA, 6373 bp, Homo sapiens
  ENST00000427431
tcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaaggaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaa

SEQ ID NO: 23187 - DNA, 3824 bp, Homo sapiens
  ENST00000438543
agtgtggcctgggctgactaatgtacactctctacacccctaagaaaggggttgtggaactctgagtgggctgtggaagtattttcagaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgaggaagaactttacctttgtgacagctatcactcatggagtgtgcttaccactcccagtaccaatgccaagctttgcgtgactgctgtgtatatattatctcatttaatcctcatgacaacctgatgaaagattggttatgaaatggatgattatccactattttcagataaggagctgcttagagagtattggagctttcgggaagatgtgatgttactgtttaaagcaatatgacatttaaatgctacagcagaagacttcacagttaactaattgctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagt

SEQ ID NO: 23188 - DNA, 5247 bp, Homo sapiens
  ENST00000504005
atgatcccgatattttaaaagctgagatctccactacaagattaaggtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgct

SEQ ID NO: 23189 - DNA, 553 bp, Homo sapiens
  ENST00000506225
aatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctgtattggagctttcgggaagatgtgatgttactgtttaaagcaatatgacatttaaatgctacagcagaagacttcacagttaactaattgtgagtttaatacactgttgtgcgtaataaccagaaaaccattatgtcccagtaaagttacataagtattcaaatgcaggcatctagagatgtgccatgtgttcagaaaacaatgtgagtctccaattgagcttttctctgcagtccagtgggaagcacagaaacacatgtttcatgatgaacaaagt

SEQ ID NO: 23190 - DNA, 641 bp, Homo sapiens
  ENST00000515284
aaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgttgggagctcaaagatgatgtgtttacacggcttacagtgaaacctttgtaggctcatgctttattccagaatgatggaatgcactgcaccttcaggaagctgtgctaggaaaagtctttccttggtcattagagagttaaggaagtaatggcaagattatgggcaaagttaaaacattagccagattctttgttcttgtttcgagtaattttaaaacactattttctgagcctttttttttttagtctaaacttgattttgaaaggtatggtagcttattgtagagttatagataattttaaaagtgactctatttttcttttaactacctggaagtaccatttaggctctagtaagacaaagcaggtatttaaaaaacaacttctgagtactcatttctctgttaccactcttaccttctttttctgtgtccttccctgtatccatacccaatcctttaaaaa

SEQ ID NO: 23191 - DNA, 1216 bp, Homo sapiens
  ENST00000508747
tgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaa

SEQ ID NO: 23192 - DNA, 2865 bp, Homo sapiens
  ENST00000434839
agcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttg

SEQ ID NO: 23193 - DNA, 446 bp, Homo sapiens
  ENST00000421322
tacaacccaaggatggaaggcccctgtcacaaagcctacctagatggatagaggacccaagcgaaaaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactt

SEQ ID NO: 23194 - DNA, 724 bp, Homo sapiens
  ENST00000417942
gaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaa

SEQ ID NO: 23195 - DNA, 750 bp, Homo sapiens
  ENST00000416330
cagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtccatccctcatgaaaaatgactgaccactgctgggcagcaggagggatgatgaccaactaattcccaaaccccagtctcattggtaccagccttggggaaccacctacacttgagccacaattggttttgaagtgcatttacaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaa

SEQ ID NO: 23196 - DNA, 19275 bp, Homo sapiens
  ENST00000429829
ccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaa

SEQ ID NO: 23197 - DNA, 1734 bp, Homo sapiens
  ENST00000635841
ggacatggtggtgagccgtggcaaggaccagaatggatcacagatgatcgttggccaacaggtggcagaagaggaattcctgccttcctcaagaggaacacctaccccttggctaatgctgggatgccacctatagaaaagtcagagggtccagatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaa

SEQ ID NO: 23198 - DNA, 676 bp, Homo sapiens
  ENST00000433732
ggtgtctctagtgactcatcaagtgatatttggcaagacattttcccatttatgccagtttcctattctgttgaatgaggaaattttctctctaaagacctaaaagttttgactttataggtttcaaagttctgtggaaacattttctattgcttattaatttgaatcttatgtaactctagcacagtactcaatatttatggcatttacatggtttatctcatgtttttttatagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtcc

SEQ ID NO: 23199 - DNA, 583 bp, Homo sapiens
  ENST00000602587
ccactcttcaatccacatgaagaaaaggatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcat

SEQ ID NO: 23200 - DNA, 437 bp, Homo sapiens
  ENST00000445814
ctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgt

SEQ ID NO: 23201 - DNA, 775 bp, Homo sapiens
  ENST00000602863
aaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagca

SEQ ID NO: 23202 - DNA, 827 bp, Homo sapiens
  ENST00000602495
agatagccaattattaaaaacagtcaagacaattgcacctctaagcagtagtagcagttgccacaccaccttgaatcttgaagtattttcagcaacaggatgaccattagccacaaatttagtgtcagcccttaaggtcggtattggtttgacccatattttcatgtagttctttttcttcacttgtctaatcttcccgtgtactgccagggcttgtcattagaggactttagggagaccaagcaggctagaaagtagagacaggagatacctatgtctaatgcttcagtttatacttcctaggtttttttcattggggtttttgtaactcttttggtatcctaccggtgctttggtagcctactgaaccctgtctttcttcttaaggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactg

SEQ ID NO: 23203 - DNA, 7844 bp, Homo sapiens
  ENST00000562532
agctcaggcgggtgggggcggggcggggcggcgccgaggagaatgaataattgaagtggaggggaggaggaagaagaggagaaggaggaagaggagccgcccgcgcagggtcctccccacgccgcacccccctccgccgcccggaagtcgctccccgcctccctctccgccaacatggccgcgaagtcggatggagcggcggcctcggccagcccggacccggagggggctgccggtggagcccggggcagtgccggcgggcgcggggaggcggcggcggcggccgggcccccgggggtcgtcggggcgggcggcccggggccgcgctacgagctgcgggactgctgctgggtgctgtgcgcgctgctcgtgttcttctccgacggtgccacggacctgtggctggcggcctcctactacctgcagaatcaacacacctacttcagcctcaccttgctgttcgtgctcctgccctcgctggtcgtgcagttactgagcttccgctggttcgtctacgactactcggagcccgcagggtccccgggacccgccgtcagcaccaaggacagcgtagccggcggagccgccatcagcaccaaggacagcgccggcgccttccggaccaaagaaggcagccccgagccgggtccccagcctgcgccctcctcggccagcgcctaccgccgccgctgctgccgcctctgcatctggctgctgcagaccctcgtccacctcctgcagctcggccaggtctggaggtacctgcgcgccctgtacctggggctgcagagccgctggcgcggggagcggctgcggcgccacttctactggcagatgctgttcgagagcgccgacgtgagcatgctgcgcttgctggagaccttcctgcgcagcgcgccgcagctagtgctgcagctcagcctgctggtgcaccgcggtggcgcgcccgacctgctgccggccctctccacctccgcctccctcgtgtctctggcctggacgctggcctcctaccagaaggtgctgcgggactcgcgggacgacaagcggccgctgtcctacaagggcgccgtggcacaggtgctgtggcacctgttcagcattgccgcccgcggcctggccttcgcgctcttcgccagcgtctacaagctctattttggcatcttcatcgtggcccactggtgcgtcatgaccttctgggtcatccaaggggagacggacttctgcatgtccaagtgggaggagatcatctacaacatggtcgtgggcatcatctacatcttctgctggttcaacgtcaaggagggccgcagccgccgccgcatgaccctctaccactgcatcgtcctgctggagaacgccgcgctcaccggcttctggtactccagccgcaacttctcaaccgacttctactcgctcatcatggtctgcgtagtggcctccagctttgcgctgggcatattcttcatgtgtgtctactactgtctcctgcaccccaatgggcccatgctgggtccccaggcacctggttgcatcttccgtaaggcctcagagccctgtggcccacccgctgacgccatcacgagtccccccaggtccctgccaaggactacaggtgctgagcgggatggggcctcggcgggagagcgtgcagggacccccaccccacctgtcttccaggtgcggcctggcttgcctcccacaccagtggcccgcaccttgcggacagaggggcctgtcatccggattgacttgcctcgcaagaagtacccggcctgggatgctcattttattgaccgccggctccggaagaccatcctggcactggagtactcctcacctgccacgccccggttgcagtaccggagtgtggggacttcccaggagctgctggagtatgagaccacagtgtaggctacagtgtcccagcacaaaagggacaggcttggctgatcccacatccgccgcagtgttgtgccccgaatttcagggccaccaggctaagggggagtggatctgttggtccaagggtagagtggccccactcttgggttctttcaggggagggggcagccttgcggaggccccagccctgggccccgttttcagccttgtggcccattccctaaattcccctgacccagggcctggggaatcatctggtgctacacttttcgagctgccctgctttcatggggcctccacacctctcccctgcctggcgttgcccatgtgttgcccctgctggacttgccagagaaagggcactgtctggggtccatgacctagaccctgtgctcctcaggggttgtggagagtgggctgcctctatggtgggaaaagatctctgagaaggatggaggtggccgtggaagggatggggtgaggttggagcattgtgtggacagggatggcgtggctcctgtagcatctgaggcctggagccagggcaagagggagctgaagaagggagttggggtggggcagggtgttggggtggggggctggcagtgctggagatggataggagaaagaactggggggggggtctaggctggcagaagcatggaggggtggaagacttgggggaggggaacctgcaatccagagcatagcgaacaagaatgaactccttaggagacgtctcttgttgtgttgtgggctctgtgaaggatgaagttccacacacctcaggtgaaatgtttgaaggagccattttttgttctagatgtgcacctggaacgtggcttctagatacaggtcttcaacacagcagataagatgtctggaaagatctctgggctcaagtgcaggtgaggttttagcacagttatcagaggaactgatccagaagcaggcttagttctagattgagttctagagtgctaggctgataaaatgtcccagggagccactctgatctgtgtattctgttgtgaggaggaggacactggaggcctgctgctctgctgtgggggattctagcacctgtcacagtggtgggggagaagaggttctagagcccagcgtgaatggaattttctaggaatgggtgctctcattctagacttctggggctcatgggagctctaggcccctgttaccttggtccatagccatctttctaaaaggaaattgtcctcagaacccctgagacatttcagctgccaactggttcccagctggaaaaaaaaatagctctggggacgtgacatgaatcctggctctcagccactctgcaaatggggctccctggagcggcatctgggaaactgacttgttttgccttagatctgatgactccccaggacctgtggtctattcccatggcctgaacatcctggagtgcccaggggactcacccagggcccctcctcccacctaggacagccagtgctggattgagggggcgtatgggagaggggaagtaggcagttccatggggtgaggagacagagcctctagcagagctgggaacccaacccaccccccacccccccacacacacactcccacagcaacttaggtgtgattggtgggagaggacagcagcggatgttaaggacagatgccaacctgatcctggagtgaggtgggccatgagaatcctagactatgcaaattagagggatgcttagccctccctggttcagcctctcttgggttacagatgggaaactgaggcccagagtggcagccactctctcaaggtcccagactctgggctgcccatcaaaaggtgatgggtaatgatgaattgctggggatgcagggtaaccccaaaggcagggagggccagactgcccacatacacacaagcacaagcacaaccatgatacgggtcaccctccccaccagcacacaggccgagatggtgtacgcatcatccctcctgccaacacagcaagagtgcttttccttctttctgctgctaagcaccctcaggaacgaggcctcgagggtgacgggaggtgggagaagcccaaggctgacccaggcccactctgttgggttcatccatcctccaaatccatctttggaggctgaattcacacacaaagccgttgtgagatgggagctctgaagatgcggacccagacccagaaacagactgtttctccagggccaactttgtgccaggaattttcaccccatgtcgtttcacttacactctcctctggtcacgacgtccctgcaagagaggtattatcaacccatcttacagacgaggaaactgaggcccagagatgtagcatgagggtcacccttggcaagttattctcctccccagtatcccagaatggcccatctggctgctgccttctagaggaaaagtcctagctggggtcctttacactccaggagactcccaaggggcagggatgtgctggcagggcttggcatggtctgaggctcgcagggaagccatggctacatttttggattttactccacccccactccccacctcttctcaaccccacacacccttccctcagggcttctgcctgcagggacatctgggcacaggaatggccacagtcaaagggcccagggagagggctgcaggcacctcctcctgcttctcaccctcagaagagtctcagcccttaaaggactctccacccaggagctcgggaccaggcctgaggccccctgctccactggcttgtcccttcatttcactgggatagaggagtcagatgagggaggggtccatccccttggagctgttttgtttttctttctgtgacacaatctacctcagccagtctctcccctagcagaactgacccccctggtcctctgcctcctgtcccctgacccccaccccagtctggatgttcagtccttccctgtccttcccaccctgccagggtccttgcagcccagagggtccctgagggttccttaagccacctgccctccacatccattagacaggagaaagtgagacccagagaggaccaaggactcaccaaaggccacacaggaagtcagtggcagttaggatttccctggggatgagaggtagttgggtgtgtcttaattttgccaggaacagaagagaacaggatgctttgggtaccaaatatggcaggccctgccctcagttacctctaaccccaggagaccagtgtccccatctccagggcagacttctgtctacctgttttcttagaactgacccccacgctgttgactgtgttccccaaacctctgcaggcaccacacacacccacatcacggcgcctcctggcactgatgtgccatgtgccttgtaactgtcaccccagctgaacagcacagacctccccactcccccacacagggctccccaatgagggagccttgcttgatcccctcctgtcatctgcctcattcttgtgtctcccccaaatctgccttacccccagccagctccctgctacacctgtgtcccacagaggcatgtcacccatgagagtcgggaaagacagagggcagggaaggtgaggcctggggaaagtccaggcctctggataagggctgagggagctgggaatatccagggaaggtctcgcttgcagtcaacaccctcctaagtactcgagttctgcaggttcttcccttggaattaatctggacctggagtccacagaagcctcagacaatagggagaaggttttctgggacgaaggctgcatgggatgcaaactcaaatgcctcgagataatgaaactaagagtaatggagacaatagggagtgttggggactctggcagacaggagagtgagtgtgtgccctgcctgtaggtactaaaattcaaatgtttgggaaactgctggccactcatatttggcccacgtgccaccagtttgagacttacggttcaaaatgttgagaaggttctggagtgtcctgccaagtggaaacccctcagcggaagtcagggacagaggctgtggctccctctgagactttgctagtccaaccctaaatccccatcacctggctatctgagaactgagcccactgccctctcagctgaaaagggaaatctggggggtccacagggtccctggtttgggaatcatctgataagggctacaggcccctccagtgcctcatggggttagaggctgctggagtcttctccagcttgggggcccctggttaggaggaatctacattgggttgcaggggagtccaggtgcaggatgtggactgaaagccaggacccaagagtcccattctgtgctggcccctgccacctttggcacctgtctccctcccagttcaagctgtggtggggcctgcagtagaggttggtagggggagctgtagtttctatattaaagtgctttgcagtgtctcaatggaagggaacaagtgggtgtcaagccgcatgggcagtagtagggttggggtttgagcccccttcccaaccatagaggcttctgagacctggggctggggaggaaaggagcttcaatgtgccattctggttggggagaggataggacatttctgggtccttggctgctgccggtagaggtatggggaggaaaaactctagagtgggagatgtggaagtggaaaaggaaggccctgtccaggcctggcctggtttctggagacagaaaactccccaggggacagagaggttacccccttgtgcttagcttctgccacccttcccttctctggaggagaaggctgccctctcctcagcaaccctggcctttattctatgcataaccactgcaagggcacccctggccaggctgaatgggtgggggtcccagggcacctgcaataatctcagaatggagggtatcctgggacaaagagggggtacagaaggtgccaggggggaaaaggtgattcctccatctctctctcacccaaatccccccagatcgaatctgacccttttccctggtctccattgtgctaaaccaccgaacttggaggagcctcatataaacatagcccccagccccactggctttccgaacccatcatgaaatagctggaaggtatctgaaccgttcccatagctccctcattattttcttccctgaggatcctgtggtttaggagatttttctcccaaaccagcctcatttcttgaagaagaattcattttcccatattaaattaactcaagctgagcttctgattgcagataaatgtttctaaggcctcaagtcaacttctagggcttgaaggtgggggaatatatgtattttattgagttgcttaatacaaaattctcaaaagcacttgtgggcactcattcctgccttcacaggccctcagggtctgggaccccacgttgggaatcaatggtttagacatccagcatcctattttactgaaggggcaagcccagagatgggagatggccagcccaaggtcacacagcaagttggtggcagggtgagaccagaacccggttcttttgagggtcccaccagaatatccccagccctgatcctcccctccatgcccctggaactctaggaatcactagccatgcctgaggggctaatctccctctgtcagcacaattccgagtgattcttcccctccctgtcgtctcttcctccctaacgggccctcacccctgtcctcttctgtttccttttcctggtcccacctcctggtatttactacatctgtgccatccctcatccccctgacccccattcaccctccgagcttcccccaggagggggagggggagggggccccgagctggggcctctttactgagactcttttgtacaccacaaactttttgtatatttttaattttgctgcgacatgagatattaaaagtcatttcagtacgtgc

SEQ ID NO: 23204 - DNA, 2339 bp, Homo sapiens
  ENST00000530562
gtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagttcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctgagtctcaatatgttgcccaggctggtctcaaactcctgagctcaaatgatcctcctgcctcccaaagtgctgttatcacaggagtcaaccactatgcccggcttcctaataatttttactgctgctctcaaagtttttgacaacgcacttgtgttgctggcaaacaacattttcaccgcaatgctgagccactgctaacagaccattagctaaaaatttacaaaagtgaaaaaaatcatgtatccatttaaatattcaaatgaatcatgttggtgttttctcaatatggagttctgtacaagtttttgtttctttgttttcattgcttttggttgttatttataaggatttgagaacttggtctctagaagagagtttttatactgaaaaagactaagggagggtgagaaagtagcattttaaatgtgaataaaaaatatcaattgct

SEQ ID NO: 23205 - DNA, 5681 bp, Homo sapiens
  ENST00000340360
agtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcagg

SEQ ID NO: 23206 - DNA, 4695 bp, Homo sapiens
  ENST00000321448
ggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatca

SEQ ID NO: 23207 - DNA, 5084 bp, Homo sapiens
  ENST00000531849
aatcgggatccgtagtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtacggctctgccacagctgccaggatcccagatccagttcacgcctgctggctaaaggcaaagaaagggcttgtgtcagtgcaggaaaggcccttagagagcaactgcctacatcagtctctacatgtagatggacaaaaggagagccagcgtgaggcagggagttgcctaaaatcacacagcatgttaaggtcctgaaccagggcttaagatagagtcaatgcataggggcagtaggaagtcagtgacttcccaagctggaaaggccatttttagccccttagcatcctcctgccacaccatcccattttccaagggtctctggacccaatcctcttgcttctggctaggtgagaaccaggatgagcttggtgcctctcctggcttcttttcctgcaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaat

SEQ ID NO: 23208 - DNA, 1588 bp, Homo sapiens
  ENST00000531449
gcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaa

SEQ ID NO: 23209 - DNA, 2505 bp, Homo sapiens
  ENST00000527087
gtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaa

SEQ ID NO: 23210 - DNA, 2995 bp, Homo sapiens
  ENST00000431210
tgtttttattcaggtgataattcttcccttttttatattgttaattttcctcaaatagtaggagattcttgattattcagtctttttgtgtaacaatcctcaatcagaagcttaaaatgcagtaattcctgtgattgtggggagagcaggatgcgcgttcagacagcgtgcccatctttctagaggtgctgttgttttctagggttcattgcttagcactcacacttgcaaccatggcccatcccccagggaattcctactttgttcattgcacaaagctttcccaaactcccttgcagaccctcatcacaggagaagttatttatgccatgttgttccatctcctattactgttttcttcattttcatgtgacttgtctcattataatatcattaacatgtagaaggtgtcggttaactagggtaaaggtgagcaatgtctgcacaggatctagtcccagcagatgctatgctgtgttaggttgaactcagctgttagactcatctcattctgacggtcccaagaatgaaatcactctgcagcctcctccttatgactgtgtgctggttgttcttggtatctctcctgaattcactggctcaacacattctgtttctactaatataagaaatatttccaaatcctctgacagaatgtcttctatatacatttttctcttctaagacagttggttagctttctgctcagtatggactccccagtaattctgaggctcgaaagtgcttatgtgctttaaagtcagattgaaggtcagtcagtgtggctgaaatacagtgaatgagggagagtatcatgaaatgagactgaagaagtaggcaggggcccaatcatgcaggacatcagaggactagataagcagtttgtattttatcctaagtgcaaagggacttattacctgatgcatgtcacagccagctcctcttcctagttagcactggggctgaggaccaatgagaactccctctaggaggtgccctgctgcacacagtggatggcagacctatatcctgggtgctctaggcatcaatcagcggtctcaccaaccttcattctgtttctcttctgtttcagaggttgtgttttcatcttaccctggattttcaacctcagaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtaaacatccagctcactgaatgtgtaaatggcccctgagtaccgcccacaattacagatgtggctgtcaccttgggaccctctgagggccatgctttcccagcacccccagatgccccccagcctgttgctgtgactgtatgaagttaggccagggaagtctgtgcataaacctgggataacaccctcctccatgaccttctgccaggcccagagaatcccgattccacccccaaagaagactagagcccaacttctggatgacatcttcattcgcttgcgggatccccggaacattacagaggctccactaggtacggctctgccacagctgccaggatcccagatccagttcacgcctgctggctaaaggcaaagaaagggcttgtgtcagtgcaggaaaggcccttagagagcaactgcctacatcagtctctacatgtagatggacaaaaggagagccagcgtgaggcagggagttgcctaaaatcacacagcatgttaaggtcctgaaccagggcttaagatagagtcaatgcataggggcagtaggaagtcagtgacttcccaagctggaaaggccatttttagccccttagcatcctcctgccacaccatcccattttccaagggtctctggacccaatcctcttgcttctggctaggtgagaaccaggatgagcttggtgcctctcctggcttcttttcctgcaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggc

SEQ ID NO: 23211 - DNA, 414 bp, Homo sapiens
  ENST00000530280
gtcctaccagtagctctcttcccatctctctgcgagttcgtctttcataacaaccctctggtggcccatacacgaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatctt

SEQ ID NO: 23212 - DNA, 542 bp, Homo sapiens
  ENST00000529926
gtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtagggcttccaaggcaggactcccacccccaggaagagtgcagcctattataatgtatgcaaaccaacctggctgtagagctgctcactccacagtgcctggaatctctccattaggttcagcattgccttctcctttccttgctttgggaagagcactggatgaaacaacagatatgaaaatatattttaaactcctaaaactcttaccattgaaa

SEQ ID NO: 23213 - DNA, 412 bp, Homo sapiens
  ENST00000528819
gcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagacaaccaagatatgttcacttcctcccatattcgagatccttcctgtgaagtcactgaaggccaggaaccagacgctggccccacccttcccagagctgagataccttagcctggcc

SEQ ID NO: 23214 - DNA, 986 bp, Homo sapiens
  ENST00000525407
cgagatccccggggggctcgcaggcgcgcatccctcctgactgggacgtcgcctccgcagacccctcggaggctgaagcgacgccggaggcagggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaa

SEQ ID NO: 23215 - DNA, 1016 bp, Homo sapiens
  ENST00000528219
tcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaa

SEQ ID NO: 23216 - DNA, 644 bp, Homo sapiens
  ENST00000526047
ttggggattctgccacacctccgtgtcctgctcctcacaggcaatggccttacctccctgccgcccaatttggccgtcgcagaacaatagaggatctaggcccagagatgctcaacaccagccggaagtcacacagcaagcaaagcagcagcagcaccggagccagagctcagggatcctggccacccttcccatgcatcttctaatatgggaggcatctgtaacatcgctgacaagcaagaggtacatcctgaggttcccagcgctggagacactgatgctggatgacaacagactctccaaccccagttgctttgccagcctggctgggctcaggaggtaaagccataagcctttctctgctgggcctcctctaatccccaggcttgctcacactctgagtgctgttctggaagccaaaaggtttgggtttaaagcctagctccacaatttatctctactgtgtggccatgggtaagtcatttctcccctctgagctttggctcctccataaaaatggccatgagtgaggacatttctgatcacatgactgaattagaagcagcaaagagaaaggaaaacaggaggagattttacccaagataggattcggaccctgacagtagagacaggaaaatttttta

SEQ ID NO: 23217 - DNA, 690 bp, Homo sapiens
  ENST00000531852
ggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgttcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcag

SEQ ID NO: 23218 - DNA, 872 bp, Homo sapiens
  ENST00000533598
tcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaatagaggatctaggcccagagatgctcaacaccagccggaagtcacacagcaagcaaagcagcagcagcaccggagccagagctcagggatcct

SEQ ID NO: 23219 - DNA, 571 bp, Homo sapiens
  ENST00000534041
ctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagttcttggacctttccttcaacagcctgactgtggaggccatctgtgatttggggattctgccacacctccgtg

SEQ ID NO: 23220 - DNA, 568 bp, Homo sapiens
  ENST00000534798
actgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaa

SEQ ID NO: 23221 - DNA, 561 bp, Homo sapiens
  ENST00000529400
agtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctggccaaggaaaatgacttcaagcattttcattctgtgatttatatcaatgcctcagaaaacctgctgcctctag

SEQ ID NO: 23222 - DNA, 561 bp, Homo sapiens
  ENST00000524430
gacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaagcttgataggagcatatcattaaagaaactctt

SEQ ID NO: 23223 - DNA, 645 bp, Homo sapiens
  ENST00000533990
cttcctggacatatcctggaccaggcttttctgctgaagcaccactgtgtgaggaagccatcagatctgtgcaccattaatgtgagtggcctgaagttctccaaggtgaggtcagccagcaaagatgtgattggggtgagccagacttgaggtggcgcacctggctgttgtggtttgtctcttgcacctccagagtccctagggactggaaatctggtcacgaagaaggagggagaggagagtcagacaaggatttattgggttgaaacaatattcagacacaaacttttgctacaaattttatattgcccttgtcctatttgatatgaattaaagaaaattgccttatgggccaggcgtggtggctcagggctgtaatcccagcactttgggaggccgaggtgggtggatcacaaggtcaggagctcaagaccagcctggccaagatggtgaaactccatctctactaaaaatacaaaaaatcagccaagcatggtagcaggcacctgtaatcccagctacttgggaggctgaggcagagaattgcttgaacccctgaggcagaggttgcagtgagccaagatcgtgccagtgcactccagcctgggtgacagtgagactctgtcaccaaaaaaaaaaagaaaa

SEQ ID NO: 23224 - DNA, 9891 bp, Homo sapiens
  ENST00000261381
gcggccgcgggagctgcggggagcgcgggggcggcccggagcgtgccggggtccccgcgcctcgctcgccggccgcgctccgaagatggtggcggcgccgtgcgcccggaggctggcccggcgctcgcactcggcgctgctcgcggcgctcacggtgctgctgctgcagacgctggtcgtgtggaatttcagcagcctcgactccggggccggggagcgccgcgggggcgcagcggtcggcggcggggagcagccgcccccggccccggccccgcgccgggagcgccgggacctgcccgccgagccggctgcagcccgaggaggaggaggaggcggcggcggaggaggaggaggacgggggccccaggcgcgggcgcggggaggcggccccggagaaccgcggggacagcagccggccagccggggggcactgcccgcccgggctctggatccacacccaagtccgctcatcaccctggagactcaggatggctacttttctcatcggccgaaagagaaagtgcgaacagacagcaacaacgagaactctgtccccaaagactttgagaatgtcgacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctgttcaccaggagagctcttcgcaggaggcctcccttgctcctgtaatcccacctcccctgaatgatgggattcccttggaaaaaggtctcacccctggtagccatctgcccttcccatggagagccagtcctgacacttctctccagcgtgggtttgaaggggctgcccttcgctttgtgtgacttgtcctaatcctagccagatgtgttgccccatcccaagcctcgcaaggcagggtgtcctgttggcaatggaggacgtagagaagggacactttagatatttattatttacatgttttagtcgatgactaattagtaggtgctgtttttgcagcttgtcaattatgttaccttactaactgaagctgcctttattcacaaaaggccccttttcccatcttttcccaccccctggtgtctctctctctctcggtttctctttctctgcgtctaccccccatcctcctcatcctcagagtaaagcaggggcatcgaacaccacgcaaagaaagctccaacccgcatcttccactggctttgagtggggtgccttggggaccgttggagccttgtttttttccttatgcagagtgtcagcctcactctccctcggattccaagagtattggaattcctgagcctcccatcctccccctactcaccccccgtcacaggcacaaggaggtgacaggcagaaaacgtggagggtgagtggggaatgtgctagctgcagagagtttgtggggaatgtgctagctgcagagagtttgggccattcctgcttgctccgtggttgccttcccatggcccatctaattatgggcattcatgcgaccttaacagagggaaacaggctcctttgagagagatccatcttaggaggagggtcgtcagatccaggcagcagagtccgggagatagccattctcaacagcgattccagggatctcagggtacttttctcagaaagcccctatgatctcttttacagactctatggtggccacgcgctgggtgccacatcctctttctgcccccggcctctgcctctggccagggtttccctggggctgccgaagccactttgggagcttccctttcaccctccttgctgggccaccagtgctttgtgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccattggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccgtgttgtgagaagcgcgctgctttctccctttgcaggggaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttgtttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatggaacagtgactatatgtggcttcttttcagcaacattgtgcatctttacacaatctcatattctcttctgtcatctgcatggtgaagataggatgactatataatttatcatccaaactgggatacttttgagagttaaaggaagcaccacgtggatgggatgctgagactgcaggcataaatggcctatcctgggaaaacctgggtgtgtggacacatttccctcataaaaactgctgtcatcttctaactggattatagcaacaacctcctataagtacctcctggttgaggcagaagtatatgatttttaaacccgtactgagtagagaataacaagaagggactgccatggaaagttgcagtttcctatacccaactggttggttggttggcaaacgtgttttcctttcctctttaccacagagactacatttcccagactgccttgctcttagctgtgaccatgtgaccaggccaatggaacagctagactgcatcttccagactgccttgctcttagccatggccatgtgactgactcaggccaatggaatg

SEQ ID NO: 23225 - DNA, 598 bp, Homo sapiens
  ENST00000575674
gctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggtaaggcagccaagggccccaagccagtcttgtctgacgtcctgctctggctggtcatggctgggaactcacgaggcagaaggagactgatgcatagtctccacaggatcgctcaggataggattctgattggacctgagaatcattgattcattcactcattcattcatgcattcaacag

SEQ ID NO: 23226 - DNA, 839 bp, Homo sapiens
  ENST00000568226
agacgtgactttcaccttctgccgtgattgtgaggcctcgccagccacctggaactgatccacacccaagtccgctcatcaccctggagactcagaaggataccctattaaacttatgaaaacccatgggcgaacatctgtgtccggaactctggaagtcaaatcttatctcctgggagtggaacagcagaatccctggatggttctgtctttgaccttcctgtatccttcactctggacaccaccccatcagcccttcaaaaccctcatgggaaagaggagttgcagaccagtggctttggccagcacctgaggcttccagcagcagctccttacacagtggcgactcttaaagtccaatctgttagcccaagggacctgaacctccatctgcaaccagcaatggcacaaggtagactctcagcatttgtgctatgccattggggaagagcttcaatttgtctgcaaacgatgctccatcagtctcatttggttccctgtctttggggagcctgggaatattgttctcgctccccgagttctgatttcccatgttaaagagatgttggaacccaaccaaagtgcaaatgtttctttgtgactgttggcacaagcccgtggccagatctgactttgtgctggcctcagcccattgtgaggtgaatgatgggatcctgttcagctgcctgcaggcaggtcagacaagggggtcaggtccctttctggcaggaagtagtgcctcaaatgttacccatatgccatgaacaagatggcagatgtggccaagcttggaagaattaactctgcagaggttaggtgacagatgtaccctgagccct

SEQ ID NO: 23227 - DNA, 359 bp, Homo sapiens
  ENST00000563403
gactgttgagctagaggaagatggtcctgtgtgtattaacctcagtgctcaacttcctgatggattatttgagtttttctgtttctgctgtgaagtcacgggatcccgaatttttcttcttgaggttggcgggatccacacccaagtccgctcatcaccctggagactcagaaggataccctattaaacttatgaaaacccatgggcgaacatctgtgtccggaactctggaagtcaaatcttatctcctgggagtggaacagcagaatccctggatggttctgtctttgaccttcctgtatccttcactctggacaccaccccatcagcccttcaaaaccctcatgggaaagaggagt

SEQ ID NO: 23228 - DNA, 1590 bp, Homo sapiens
  ENST00000007699
ggttcgcgagccggggggaggggccggggcggtggcggctgtggccggtactggacccggcgggatgagcgaggtggaggcggcagcgggggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggctttcctgtggt

SEQ ID NO: 23229 - DNA, 2195 bp, Homo sapiens
  ENST00000571834
aactaggcaaacctctgagcctggcaagcaggtgcactggggacccttgcattgggagggctagaaaaaccctcagttatgacctgggggcggcactttgcagaccagcaatccaagtcctgggcactgtcaaatggttcaacgtccggaatggttacggattcatcaacaggaatgacaccaaggaagatgtctttgttcaccaggtaagagctaggttagctttctgaggggaagaaccggccgtctttgaaggcctttgctgtaatccttagcagtgcgctccgccatgtttctctggctcttcttcacaacggcccatccgccttgggtgcctgtgtcaaccaccattagccgcacttgtgctgggttactaaacgtccgtcagaattgagcatgttacccctgggcatggcacgcttactacccaccgggacctgttaacactccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 23230 - DNA, 4553 bp, Homo sapiens
  ENST00000571485
ggcgcgaggaccgagcagggcggtgggttcgcgagccggggggaggggccggggcggtggcggctgtggccggtactggacccggcgggatgagcgaggtggaggcggcagcgggggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctgggtgaggggcaggcgcgcacagggcggctctgaggggtcggcgggctgggggaggggcagtgtggagcccggcaggatccggaaaaccaaaggcggcctggcccgcaggcccagagcgctaactgggctgggagctgcgcaccaaagtggattcccctggtgggaaatcctgccgtaccttcctgggagagagggcggggccggcaggttcagctaaggtcttggggtggagaataaagccccagggtccggccacgcccccgggcgggacacagtgcctagttgactgggttagaactaggcaaacctctgagcctggcaagcaggtgcactggggacccttgcattgggagggctagaaaaaccctcagttatgacctgggggcggcactttgcagaccaggtgagtacccagttctaggtgaaggggctggatttgtaggatgtggggaacgtgacttagagttggaaggctttttgaaagcctgagtccctgtgtgggtgatttcatttggtggactagggtaggaataccttgaagctactagtgaaacctggttggcttgaaggtaacctgaataggtaataaggcagtaggctagatttttttttgttttggagtgtctcaaaactgagttcaactccatctcttccccccatctcactgtccccactgcatctctgcctggcagcaatccaagtcctgggcactgtcaaatggttcaacgtccggaatggttacggattcatcaacaggtatccaaggaacccagggcgggggtggaatgggtgtcttcccagctggcctgtgggactggacacccgcccaacctcatcgacccctgcggaggcacatggttgcaatgtccagctgatgctggttgaaagcctttaaccgcagcacaaatgtgtgcttcgtgacaagaggaagcctcctccgcatcttcaagggtagcggaggattaatgattcaggaacttggcaaacctggctctgaccctgccagcttctcatctcaccttctggaattgcttcattacttttactctgacatgcctttggggcagaatgtattatagggttctctgtgcctcagggcccccggctggaatcctcaactgatttcctgttatggcagcactcacaactcaactcccttaaagagctgtggctcattcgagccctccacctgttgggactgaggctgacagtgggggtcaggaggaaggagccagaggctgctgctttccttcagtaggcagccccacccctcagcaccgggagaggctgtggcagtggattctgagcagagccaggtctcccccagtgggcccttccccagcccaggcatcctgcccggcctggctctcctgggaggccctagttccctcttagcaggctgacctttgtgcagatccaagtgctttaaagctaaaacgtttgttctggggaagggtccctgtctaattctggaaatggcagactgggtcgggggcagagtgcctccaggaaaacttttcctttctcccctccccccacccactggggttcttatgatagagaatgggtgaatgttttcttctctctcacccttggtcccacgcgtgttgagagtggtcctgactctgggattcacctccaggctgaggatgagaataaagtttggcagctgtttagagcaagttcctgacacattgttcccttctcaaacttgttctgcccctctggccccatctgcactttctgcctccttgactatagaaggaagaagactggaattttccaaccctgatgggggttgggggagggggtgttggccagggacagttgcacccagcgctggcaggttgtaaggctagcctggggtggaaggtggagtcccggcaggggcagagctgtctgaggttcctcaaggtgcctttgcctccccagcctgccctttccttgtgaagtccaggtttggcactgaggttttaggtgtatctctctttacaccagcttctgggggccctgctggctctccctcccattccccaggccatgtccacccctaactggaatgctggagaggatgggcccactgagcttagactgggcatctagggggacctcagtgaggagctgagggctttgttgaagtcccttccttaacgacccatcctgttctgcaggaatgacaccaaggaagatgtctttgttcaccaggtaagagctaggttagctttctgaggggaagaaccggccgtctttgaaggcctttgctgtaatccttagcagtgcgctccgccatgtttctctggctcttcttcacaacggcccatccgccttgggtgcctgtgtcaaccaccattagccgcacttgtgctgggttactaaacgtccgtcagaattgagcatgttacccctgggcatggcacgcttactacccaccgggacctgttaacactccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 23231 - DNA, 640 bp, Homo sapiens
  ENST00000571464
ggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctgggttgaaggaagggagccatccttactgttcagagacagcaactccctcccgtaactcaggctgagaaggaaccagccagctcttacctcctcctggttgcttttctt

SEQ ID NO: 23232 - DNA, 606 bp, Homo sapiens
  ENST00000570720
tctcactattcccttaccaccttcccagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagc

SEQ ID NO: 23233 - DNA, 653 bp, Homo sapiens
  ENST00000570627
gctgccggcgtgtgggcgaggctcggggcgcgaggaccgagcagggcgcaatccaagtcctgggcactgtcaaatggttcaacgtccggaatggttacggattcatcaacaggaatgacaccaaggaagatgtctttgttcaccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaag

SEQ ID NO: 23234 - DNA, 791 bp, Homo sapiens
  ENST00000571127
agccggggggaggggccggggcggtggcggctgtggccggtactggacccggcgggatgagcgaggtggaggcggcagcgggggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggtatccaaggaacccagggcgggggtggaatgggtgtcttcccagctggcctgtgggactggacacccgcccaacctcatcgacccctgcggaggcacatggttgcaatgtccagctgatgctggttgaaagcctttaaccgcagcacaaatgtgtgcttcgtgacaagaggaagcctcctccgcatcttcaagggtagcggaggattaatgattcaggaacttggcaaacctggctctgaccctgccagcttctcatctcaccttctggaattgcttcattacttttactctgacatgcctttggggcagaatgtattatagggttctctgtgcctcagggcccccggctggaatcctcaactgatttcctgttatggcagcactcacaactcaactcc

SEQ ID NO: 23235 - DNA, 4554 bp, Homo sapiens
  ENST00000577961
gctgtggaagagagccaccattatcaaaatgatcacagttgcaaacattcgtgcttcaaataccagccactatgttagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 23236 - DNA, 4639 bp, Homo sapiens
  ENST00000584307
ggtcgggagaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 23237 - DNA, 4441 bp, Homo sapiens
  ENST00000314574
ttgctgccgccgggcgccccgggacgaggaggtggaggagggagagggcccgcgggcctcgcctccgccctccgccacctcgagctgcggtagcagcgactcatgagagcgcggccggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcac

SEQ ID NO: 23238 - DNA, 568 bp, Homo sapiens
  ENST00000577611
aacgcgtcccgggccggctctgccgtcgttgctgccgccgggcgccccgggacgaggaggtggaggagggagagggcccgcgggcctcgcctccgccctccgccacctcgagctgcggtagcagcgactcatgagagcgcggccggaggacagataaggaaactgggacacagaaaggttgagtaacttgttgaagttcacccagctaatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagat

SEQ ID NO: 23239 - DNA, 487 bp, Homo sapiens
  ENST00000581960
aagtcagggggcggggccggggggggggggcggaggaggtggagagtgaggccgaggcgtggggagcccgggaactccctcctcctgaagtaacgcgtcccgggccggctctgccgtcgttgctgccgccgggcgccccgggacgaggaggtggaggagggagagggcccgcgggcctcgcctccgccctccgccacctcgagctgcggtagcagcgactcatgagagcgcggccggaggacagcgttgatgccttacctggacatttcgaggctaaagcagttgttgaactccagagcattatcaagtcttcacagcttaaaaacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacag

SEQ ID NO: 23240 - DNA, 3147 bp, Homo sapiens
  ENST00000274496
ggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttaaagagattttcagactaaatagaaatgtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgtactgtgtctcaaaaagta

SEQ ID NO: 23241 - DNA, 2255 bp, Homo sapiens
  ENST00000448443
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 23242 - DNA, 2135 bp, Homo sapiens
  ENST00000513112
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 23243 - DNA, 684 bp, Homo sapiens
  ENST00000519064
cacgtagcaacggggctggttcagggtctgaaacagagtttgggggttgtttgggattagtgaagctactgcctttgccgccagcgcagcctcagagtttgacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcatta

SEQ ID NO: 23244 - DNA, 653 bp, Homo sapiens
  ENST00000522203
ctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaatatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcag

SEQ ID NO: 23245 - DNA, 793 bp, Homo sapiens
  ENST00000508754
tgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggtaagattttcatttcaaccttcagggtgcaattaaagaacagcctttaaattttaaatgttctaccaaaagccattttgaaactccgctttacacctcaagtctttgatgtgtttggaatagtactgagttgcttgtatttatacctattcattagttctccatctatagtaagtgtagcatgttttaaaaatcatttctttttctaagaaatgattaaattattaggggaaaaaacaaaaaaaaaa

SEQ ID NO: 23246 - DNA, 1196 bp, Homo sapiens
  ENST00000415895
accaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttggtgatatgatttctgttttattgcttttgagagagtaataagcagagagacaaagcagcacttaagggtggtgctctaatagcctgttggtttgaatgatgttttgcttttgagtttggtgcattaaaacatttcaaaatacttaaaatcaaaagggatacagttgctgtactgatcaaccctgcttttctcaatagaggtatttctgagaaaagtaagtaaataaactcatatgtttactaaaaggaaatctctagtaagccttttgagaaa

SEQ ID NO: 23247 - DNA, 752 bp, Homo sapiens
  ENST00000510035
atgtcatcttttcaccaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagataagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggtaatgtgtcacaggaagcaccagattttaatgcttgtcctttccagtgctggctttgaagcaatctgtataaatataagagaaactgtgtcaccttacatagtgaattttttaagtgagagagaataatttaaccatagtgacaaaaatatgctaccattatgcattgcaacagctaaaaagtataaatttaaatagaatttcaaaaatcaagaagcagatcaaagcagga

SEQ ID NO: 23248 - DNA, 583 bp, Homo sapiens
  ENST00000502794
atgtcatcttttcaccaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaaacttggaatccattttgatcacatatggcaaaaaactttgacagtgttaaacccaatgaagccagtagatggcagcattatgaatgaaacggacctcactggacccattcttttttgcgtagccctgggagccaccttgcttctggtaatgtgtcacaggaagcaccagattttaatgcttgtcctttccagtgctggctttgaagcaatctgtataaatataagagaaactgtgtcaccttacatagtgaattttttaagtgagagagaataatttaaccatagtgacaaaaatatgctaccattatgcattgcaacagctaaaaagtataaatttaaatagaatttcaaaaatcaagaagcagatcaaagcagga

SEQ ID NO: 23249 - DNA, 484 bp, Homo sapiens
  ENST00000508947
cgaaggtaccccccgtaggatccggtggacaggactcaaacagatcctgtgaagcgaagacaatgaaccccggggagctctgcccaagtaccagatccggaagcaacccgaagcggcggcgcagcttgccgacgtctgcacgccgcacgctgtcgtgacatcagcgcgtcttggcgccgggtagtggagtggtcactttgggaaagtcaggcaggaatgacttgtttctgtgatgtctgtggcctcaactgggatgactcgaccagctggggacttgaaaatcgggcatctctttctctctcatcttgtagtcacagtctctccatgtggtctccccatacagcctcttcagcatcacaatctcaggatgtcaaacttggcacaatttgactctgatttttaccaatctaattttactattgataaccaggagcagagtggtaatgactctaatgcctatggaaatctttatggatctagaaag

SEQ ID NO: 23250 - DNA, 937 bp, Homo sapiens
  ENST00000332990
atgtcatcttttcaccaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttgg

SEQ ID NO: 23251 - DNA, 2523 bp, Homo sapiens
  ENST00000335953
gggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaa

SEQ ID NO: 23252 - DNA, 4427 bp, Homo sapiens
  ENST00000541602
gagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggtgagttgacttggattcctgttctccaggttttccacagtgttggtagcacatggacatgaactgtctgggtggcaacctctttttagcaaatgtgacatccagtaatttcctgggcgagctgtgagtaggatgggcttctgccacgttcagctactcttgtctgtgtggctggcccagcagaagtttacaagtatgacatggccccatgagaatggctgtcctagattaggccaagatctgtctctaaccagccactgagagctcatgttcttggaggtatctagtatgctcttgttgaggccttagtctgtgttgttatcaaaacatcttcttcccttggtcaggaaatctctcacacccatctgatgaaactgaaaccctcgtgtggccacagttggctggtcctccctctgcgagagctgagacattgtctaaaatcagcgtgtacgcaggatgcatttgaacaatattaactcacgatgatagagctttatttgatttcaaagggattgatttcaccgcaccaaagtcatctgatcattgtgatcagagtcgttgtcatcacatcatcacagcagctcacacttaacactcacagtgaggcaggcactgttctcagtgctttatgtcaggggtccccaaccctgggatcatggactggtgtctgtggtggtctgttaggaaccaggctgcatggcaagaggcaagcggtgggcaggcaagtgaaacttcatctgtatttactgctgttcctcattgctcgtattaccacctgagctcctcctcatgtcagagcagcagcagcagcagcagcattagattctcataggagcacaaatcctattgtgaactgtgcatgcaagggatcaaggttgcatgctccttatgagaatctaatgcctgatgatctgtcactgtctcttgtcaaccccagatgggaccatctagttgcaggaaaacaagctcagggctcccactaattctacattatgtgagttgtataattagttcattatatattataatgtaataatagaaataaagtacacaataaatgtaatgtgcttaaatcatcccaggaccaccctcctgtactccgctgtatgtgaaaaggttgtcttccataaaactggtccctggtgcctaaaaggttggggaccactgctttacgtgatcccatctggccaatctctcagtaaccctgtaaggtaaggttggaagctactcttatgtcatagatgaggaaactgaggctgaaaggagggaaagtgacttgctggagttggtagtggggacaggcgtggtagagtcttatagttcagagctgagactgcatgggtttaatcctgactctgccacttcctatttgtggggccatggataaattatttaaactctcttaatttagatttctcatctgttagaaaagtggagtaatattagtgtctacctcatagcattagggttgttgtggggatgaaataaggtattttatttgaagtatttcatggagtgtttggctcatagtaagcactcaataaatagtagtaggtatatttaatgtaatagatatttattgagtttctacaaggtgctggcactgtttaggcatttaagatgtagtaatgcatgagacagacgacattgctgcctctcatggaactgagcttctagctgggagacagaatcagcaaataaatatacgatatcatgtctgcttatacatattaagtgctactggaaaaggataaggagtagagaataatagggagaaaagaaatattgtggatatttagggagaaatgttgtggataaaatggttagggaaggcctctccaagaaggtggtatctgggcagagtcttaaaaagtgaaggagtgagccactcaaaaatttctgggaagaatgtctaagcaaagggagtgagcatttgcagaagccctgaggctggatcaagcctgacaagtttaaggacccacacgcagagcagtggtggccagagagctgggagtgacgtgtagagagtggtgagggatgaggacaggatctgtcaagtctctcagccctggtaaaagatttgggttttactctgcatgtgctgagtcctttggagggtgacaaaatatttgcaaatcatatatttgatgaggaacttatagctagaaatagaaagaggtcttataattcaaaaaacataaacaaataatcaaattaaataatgggcaaaggttctgaacagacatgtctccaaagatagacaaatagccaatgagcacatgaaaaagatgctcaactgcattcaccatcagagagatgcaaatcaaaaccacagtgagatactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctc

SEQ ID NO: 23253 - DNA, 773 bp, Homo sapiens
  ENST00000544220
agcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggagg

SEQ ID NO: 23254 - DNA, 572 bp, Homo sapiens
  ENST00000535700
tcttatgtatgcggaccggtgcgcgggcgcaagataagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgc

SEQ ID NO: 23255 - DNA, 2287 bp, Homo sapiens
  ENST00000392996
agcgctgcgggccctcctcggctctcggcgggaccggcggtgacaccggagctcgccgtgcgctcccggccgctctcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaa

SEQ ID NO: 23256 - DNA, 757 bp, Homo sapiens
  ENST00000539918
atggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacagggtcttctagcataacctttgttcctgttggcaacacttcattttggactgtcaagatgcatttcctgagatgtgagatgtcatgaccctgtgtttggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggaga

SEQ ID NO: 23257 - DNA, 534 bp, Homo sapiens
  ENST00000545851
gggcacagactgtatgccaggcatggcgcagggtatcagggatatggtaaagcccaagacaggtgggaacctgctctcacagagcttacagtccactgggaagatggaagagagctccaaatacaggacagttgaatggggctccaggggcttgtccagagaagatttcagagccagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacg

SEQ ID NO: 23258 - DNA, 705 bp, Homo sapiens
  ENST00000535379
ggccatcattggctctgtgaccacattataaagttttttcgtgtggatatctcattcgatgttcttgataaccacagtggcagataaggagcaaatggatctggtgaaaagaatgacttgctcggggccacaaggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaag

SEQ ID NO: 23259 - DNA, 727 bp, Homo sapiens
  ENST00000535509
ggagagatttctttgaaggttggggagtcaggctggagtgactttcacccttaacctaaaggaaggggagaagaggtcatctgagaagcaagatggtgaggtctcatgtatccacaagggggcttgctttctggggactgctgtccatccctgaaccaaatgggctctctttcccaggactggcccttgccccacagatgatcatggggccacagtaaagtatggtcatgtgtgaagacaggtattgcttgtttattcaatggaggtgtggccgtggatccttaagttgtctttggaggtggtgaatacaggccgtcgcatccttctcatgcacagaatgtgccctactgtcccctgaagagggggcagggagaggcaaaggcctgatccagccccttgtctccacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagca

SEQ ID NO: 23260 - DNA, 6846 bp, Homo sapiens
  ENST00000398505
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttgagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 23261 - DNA, 7449 bp, Homo sapiens
  ENST00000310826
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 23262 - DNA, 5806 bp, Homo sapiens
  ENST00000398499
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 23263 - DNA, 5608 bp, Homo sapiens
  ENST00000398511
gcgatgacctcatccctggtgtgggatgacgtcaaattcaagatggatggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 23264 - DNA, 631 bp, Homo sapiens
  ENST00000465968
acagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccc

SEQ ID NO: 23265 - DNA, 607 bp, Homo sapiens
  ENST00000425521
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttc

SEQ ID NO: 23266 - DNA, 463 bp, Homo sapiens
  ENST00000449949
gtcaaattcaagatggatggaatcacagcggcagcggcggctgcggcgcgcgcgagccgagtgtgagcggaaaggggcccggcgtctgcctcgagactgaagaccgagcccccgcagaccttgtctgggacttcccggcggtcccgcagagcatagcaccctccgccggccaggagccctgctgctcggccggcgaccgtctccccgcttggaggagcccccttccccccgtccgagaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 23267 - DNA, 555 bp, Homo sapiens
  ENST00000398497
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgatctgaaaaatacactgaggagaaagtacacccggcaacaaagctcgccttatctgacagcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 23268 - DNA, 5185 bp, Homo sapiens
  ENST00000245663
ggcgagcgcgcagctcggacccgcccggacgcagcgccctcccggcggcggcggcgatcaccggcgccggcccggcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagggaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagcag

SEQ ID NO: 23269 - DNA, 431 bp, Homo sapiens
  ENST00000460757
atgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtcccgagtcgttggctgaatgcgagctcgtccgggtcgcgcaggggccgggggtctttgtgctccagagacgggctcgggcgccccctgccggcccctctgtcgccttcgtgctgaggctcgtttcgcgcaagggagatgggggcggccg

SEQ ID NO: 23270 - DNA, 629 bp, Homo sapiens
  ENST00000480766
tgccgacgtcggggtggccgttcagcagccgagactcaagctgtggcccaagtcaaggaaggatatttggagttgggtgtggtgttgcctgtgcctgtacttcagctacttgggaggctgaggcgggaggatggcttgagcccaagatgtccaggctgcagtgagccgtgattgcactgctgccctccagcctggacgacagagccagaccctgtctcttaattaaaggaaagaagaaatggaggtgtcctagcaggtgctgcccgtggggaggttcctccaggatgaagcctggaaatgaacgtgggagggcgtgagtggacagaggaggacgaaagacagcaagccgcagggtgggaggccctgaaaaatgtcgcagatgccgtgtgtgggtggcgcagtgggagacgctgcctgcccccctggctggagggcttcctgggcagggcgggtgtggcctcttctcctgaccctggtccctcctctccgtcgctgagagatctgcgagagccgggagtgaacacagctcgataatacgttaacttttatcattgtggtagaacatacataatgtaaaccttaccattttaaccattttcaaatgtacatttcactggcattaaagtcac

SEQ ID NO: 23271 - DNA, 2335 bp, Homo sapiens
  ENST00000302995
gacggacggacggacggaccgagcagccccggcgagcgcgcagctcggacccgcccggacgcagcgccctcccggcggcggcggcgatcaccggcgccggcccggcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccgggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagagg

SEQ ID NO: 23272 - DNA, 5198 bp, Homo sapiens
  ENST00000395104
gatgggctctcgcgtgggtcgtcctcccactggccgcactctgtgccccatggccctcctgcgccccgcccggcgtcctctcacggcctctgtctgtgctgagcttgggtaactcttgttcttacctccacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagggaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagc

SEQ ID NO: 23273 - DNA, 2613 bp, Homo sapiens
  ENST00000340433
accattggccttttccatgaagaagaggcaacattgagtggcggacaacactttttggcatctctccaattcagctgttagcatctcctagtgtcttcttcacagctaacagctttggctacttgctcatgacactccgtctctgatcacagagcaaatccactgtctccattggtttccagtactagtactcaattctactcaatcccacctgattccaggagacataatggagaagtgcacgaaatcatcatctaccatgcaggtagagccttcctttcttcaggcagagaatctgattctgcggcttcaaatgcagcatccaaccacggagaacactgctaaaaggggccaagtcatgcctgccctggccaccacagtgatgcctgtaccatactcacttgagcatctcacccagtttcatggtgaccctgccaattgctcagagttcctcactcaggtgactacctacttgacagctctccaaatctctaatcctgcaaatgatgcccagatcaaactcttttttgattacctatctcagcagttagaaagttgtgggatcatatctgggcctgacaagagtaccttactgaagcaatatgagaatcttattcttgagttccagcagtcatttggtaaacccacaaaacaggaaatcaatcctctgatgaatgctaagtttgacaaaggagacaactcctctcagcaggaccctgctactttccacctcctcgctcaaaatctgatctgtaatgaaaccaatcagagtggtcagttcgaaaaggcactagctgatcccaaccaggatgaagagagtgtcactgatatgatggacaatcttccagacctgatcactcagtgcattcagttggacaagaaacatagtgacaggccagagctcctacagtcagagacccagctcccattgttggcttccttgatccaacaccaagccctctttagccccacagatccaccacccaagaaagggcctatacagctgcgagaaggccagctgcctctcaccccagccaaacgagcccgccagcaagaaactcagttgtgcctctactgcagccaatctggtcacttcacaagagattgccttgccaaacgttctcgagctccggcaacgacaaataacacagctcaccagtaagaggagaccaggaaagtcactttttaaacttacatcccagccttactgatttataacctgcattaacttttaaaatacagatggggaactgtgacaccactttataggcagttatgaactgacacgctttgggggaatttaaacaatcagatcttgttcattggcaaattacccctcacgaaacctaacccgagaatgatgaaaacaattcacaggcactttctgcagttgggattaattctccaagagcaccaaaaacctgcaggcaaaactttgcccagtctgagccaatgaaaataaccgtggaagcacattgggaaccttatcctgaccaatgggtgacatctgggttgagtttgtgtcccaaatcctgaatcttgtgtgcctagaaatgagcccaagacttttaccttcacctttattggtctgtatcctagtttcctgttggcttaggacctttggctgaagtccaaatgacattcctataatctgcttatattctcctcctagagtttggaccatgcttcacctattgactacgatctaccttcagcataaatcaaccttcctggaaccacagctctgccacccttccatagagctatatgttttgtttccatctaaagactcatgctttcccaacaaacagaacctcctggctatttacaaaccagattgaatgggcatttgaatactgcttggaactgttggtccctttttctttgcaggctagcccatcaggcaggtgtatgcttttagccaagcccaccaattccaacttattcctctcttctccaacaaccctacttgaggttccagcatgtcttatagccaagtcaatatgctctaggataaggatttctgaaaggtatttagtgagagttggggatggtgtgtcataattactgtatctgtagcatgtccttgctgccttggacaagggacctggccaaataaatctccactgaagactgacagccagaccctgcagtagtttctaactctagaagcctcaatgtagtcaccatctaggattactactcattgctattgagctctacctttatggaccacctctgaagtccttcatctaattgaggatcttaaaaaacaatgaatggcaaaaaacttcctacactatctcatctgaaaaatcctggggcacatacattaaaaccatttgtgcacaaaactcaggaagtcgggattttattgcttatgttttactcttggtacacaccagctttgtgtagattcctgatgcttctgaacaaaagtagtgttatgctagaaaggcaaaactccctaaaatgttaaaactgttcagcaatgatcactgctggtaattaccagccctctgttccctgcttcttgtttctgatgtatgtccccaaaatggatatcctggagaaatatcagtaatcacatattccctagcaaccatcaaggcc

SEQ ID NO: 23274 - DNA, 4933 bp, Homo sapiens
  ENST00000372336
cgcagtcggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcagaaatccctctttcctgagtcagcaatcgtggcaaggggacatgtgttccaacagcggctggggagtggacctctctgtcccttgcccaccttaagccccaaatccagaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttccagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaa

SEQ ID NO: 23275 - DNA, 906 bp, Homo sapiens
  ENST00000372333
acccatctgtggccttcacttcctccccttgtgggggttttctctgcaaagatgcaagaggtgtgttcgggggaggacacacatgggggtcactttccttccagacctgggcacaccggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacagg

SEQ ID NO: 23276 - DNA, 3134 bp, Homo sapiens
  ENST00000414563
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttgga

SEQ ID NO: 23277 - DNA, 7380 bp, Homo sapiens
  ENST00000359775
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggatctgcgtacggttatccttaatagcataaatgaaaacaaagtcatccagatggggagagtttttcttgaaatgtccctagcgaggaatggtccccagacaaccaaaagtcaaatctttgaactgggagatatttatagaataatttcttagataagaggcaagttttccatcatttattttctttaattatctctttttgacaccatcttagtggaatttgctctacgtttgcagtttgccgtgcaacagttgatcggaagtagggagaggggaggggacgctcagggagaaggttctgtcgggcgtcttctgggcttccttctgtgttaacgtgtcactcaatcccagaagtgcaacttgaggtcctagtaaaggtatcagaaaatgaggaggagaaatcggcttacagtctaagctgagatcatgtaggtcatcatccttcctagacactgatcagaatgaaattaagaaaatgaccactttgttcactttcattggtcacctagaagggaacgaactggctctggacttagggagtgtgtcactatgggggcagccacaggggacacagcaactcctctcctggcttctttccagaccataaatctaacagctaaagctactcaagttcaaagccatggccttgctccttataaccatatgaaagacaagacacattgaccaatgatacaagtaacccaagtgatttgcatttatggaaaaaggctattactcctgagaaagagttgccattttatataaaagaaaagaagataggaaaaagaaaagcacacaagttttatttggaatgaaggcaattcacaggtcacaaaataattcatgctgaaagggcctgcagagttcttgcactgtgatgtcttcgagccatctttattgtcatgctgcatgcacgtatagaaaatggaataggtccattctatgtagccatttttgattttctgaaccacctaactacttgtacccacctgcaatgtgtaattcatggggcagtgccctccttacacaaccgcacacgctcacaggcaccaactcacagggattctccttgtccacgctacctgtgagcccaaagtgacagccccacaaaggagcttccacaacttcccaaaccgtctctgctccttgctttcttccacctgctccccagaggccccaggaaggagttggccctgatgagaacggtgctccatgggtgaccgcgaatccggcttagccctcactccggtcccacgtgtggcccagtccattctcagctcattcccctggaaagcaagatcatggtcttcagaggcctcccgcttctaacatttcctaactcagtggttgccactctcctgtgaccagcccttcttcccacctcactgtgaaaaattcccagaagccaggatcacgactcacttgtcttcacataatggatatttacttaatatttattatcaatttccccacctccaaccctgtccctggcacacacttggcatcatttatccaataggggactgggaattttggtgaagtgaatcaaggctattcagggtcaagagagagattaacttgaatgggccaatttgctagataattaatgtcttaaaaaccaaaaccagagagaagcccacagccctgtcctctgtggcttgaaaaagaaacccagcatcagaggaatgagcgatgatgccccctggggcgcccacttctgtttgtcaggagggatggtcggaggggcagctcacctggcgaggtgatggctctgcatttcccacgaacatatatgtgacatgtacataaatataaatacttatgtttataaatgttgaatggttccttctagctgtggctgagtagacgttggtgtttctaacttctttcagtgtgttagagattgattacatgctagctataaaaagtaaaataaatattttaccatgctattaaagcttggaccattatcaaacacacacaaacacacactcattctgctgtttaaaaattcatctgcgttcgttctcccaggagtgctccagggaaccacaggcttcccggcacttgaaggctgaactgagcgtgagtgccctggtccccaggaagcaggcggatgctgcaggaaggtggcagacagcctgcatccaggagggccccaggaagtggggatgctgcaggaaggcggcacaaagcctgcatccgggagggccccaggaagcagggggatgctgcaggaaggtggcagacagactgcatccaggagggcacagtgacctgtcactccgttctgcagaaattggcccagcagttgcgttatgcccaaccaaaagatgctcgttccagctttcaaatgtgatgatttcagcctgtgaggacaatgccatgtccccaccctaagccagcaaaatgcgaaatctctgttctggcccagaatggcacaagggaggagtctttgcagagttccacgccaccccccagcttactgcggccttcaccggctctgtctaggattgccagctgtggttccaagtgaggagcaaacccattttatgagccatgttcctgcggagacctgatgggccaggccttctgtggctttgaaaacccctaagctcttcacctcctgggcctaggccttcttgtctgactcaacagcaagaaaaatgaacttgccaaaattggcagtaggtgtccttgacacaggggcttctgatggcatcgcccagaaaatgctggaaccagaactggtcagagactttgaagggcacagcctggcgggctactccccaagggtctcaggtctctgcccacctgactaccctgcagcaaacgcttctctgtaacctgacttctcccttcagacctcagcctacaaccatcctcttcatgccaggaaccaactgcttctcagcctcggcttagggtcttaagttcaccagaagggatcggggtttgcgttgatattataaggaatcttcccagaaggagctgcccttcatccatccacaagaatacattgagttcatttagttcttgaccaggtaagaaaagaataaaggagaacaaatattaaatactcttttctaattgatgccttactactgttttgaagctgagccgaaatcaaattgatgtttacattttctatcaagtacacatgagctgtgggagtctagcatattcttgtccaaaagagagagactttcaaatgaattcctattcctcttggtcccctccacctattttggaggtctgcatgtggagttgtatgctattttccaaggtacctcatttaaaaaaaaaaaaaaaaaaaaactgcctctcatttgttcccttaaaacgtctctctctctcataaaactaagttatcattgaaatattaaacgatctgaagcgtctttttttttttcaaataaatgtcaaagatggtaatagtttgtaaatcagtaaatcctctgtccatctgcccattgtccatggtcctgataatagagccaagatggattttcacatgtaaggtgttagtccattaatccagccattaaaagtagttgggagattgaagattagatggtttctggagcaaccgaatttgcagctgccacaaaactagataaatagccacaactggagttattttttgatctcataaaccccaggaattacacacagaatggattgaaaagcagacaagcatcttgtgctattgcagagacttttctacccaggaagtgttgaatttttaaaagaaacttgatattggtgataaaggtatgaatgaacaactctcttacttgccctcgatgtttcaagatgcctggtgaaaccgagaggccacatggcatgtccaaggagacatgctttctgggttctatatgaatagagatggttttagcctgcaattaaaaaaaaaaaaaaaaacggttgaagccttgctaactttttcccagagcattctgggttgatatttcacagtcaaacgttttggcatggaaaaaaaaaaaagcattttaaactcttagtgaattcaaagctctaaatccaaacaatggtgaacacatgtacataacatttcatgttttcagagatacgtatgcttatttaagtgcctttcatgttttaatcaatgtttgcagaatttatcttaaacctgagatgaattaaaaaatttttctccttcaataaaaactgctaatggca

SEQ ID NO: 23278 - DNA, 861 bp, Homo sapiens
  ENST00000518214
ctgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactg

SEQ ID NO: 23279 - DNA, 571 bp, Homo sapiens
  ENST00000523468
ccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgtaagtatgctggcgaaatcagattacgtatgtaaccatttgcctgactttgattttcctatttgattttgatttaatattttggtcatttcgggctttctctttccctttctttct

SEQ ID NO: 23280 - DNA, 1934 bp, Homo sapiens
  ENST00000341375
ctcagtcacgtggcccctgcacgtgtgcaacgaaggaggccggggtcccagcggaggatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgtta

SEQ ID NO: 23281 - DNA, 328 bp, Homo sapiens
  ENST00000340347
caggggggtaccgcccgcctcccagaaccaaagaagtcatcatcaatggccagaccgtgaaacttaaatactgtttcacctgcaagattttccggccccctcgcgcctcccattgcagcctttgtgataactgcgtagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgagga

SEQ ID NO: 23282 - DNA, 5146 bp, Homo sapiens
  ENST00000523706
aatgtttccgtaagtatctgcacaacggcttcacttccttcccaggccgcggtgctcaaaccacaaatggcgtgggctgggctcaggctcacgttaggagtacatcttcctccctttctcttctggtgggttcgtatgggggtggggaagtgggtgggagagaatgttttgcattcattctttttgaatattagtcaaattgggccgttaaatggaacatcccaaattttcataggtactttcaatcctagttgccattctttctgactataatctttcatccaaacgtgacacaaatgtgtaatatgtgcttgagagccatgacttggtgggcttgcaagaggacaatggacacccgccttttccacatcagctgggcaggatgcagacaggggcaccctctccctctattttcaaagtcctcaaaatggcaaaaatgtggctagggtcctatctgtgcattaatagacaaaagaagcagagagaatgactagggcattatatgttattttcaaagaagcagttgttgacacaactagggaagaaatacgaaccgatcctccagcacacacgtaacactgaaaagcagtgtttagacattatttatttttatttttgagatggagtgtcgctctgttgcctcagctggagtgcagtggcgggatctcggctcactgcagcccctgcctcccaggttcaagcaattctcctgcctcgagtagctgggattacaggcgtgggccacagcacccggctgatttttgtatttttagtagagatagggtttcaccatcttggccagactggtctcaaactcctgacctcaggtgatccgcctgcttcggcctcccaaagtgctgggattacaggcgtgagccaccccacccggcctagacattgtatttttatatcacctttcacaacctcaagatgcttttgtgtgtattatgggattgtatttatggccttgtccctgcattgtggatgtcaagggccagttgccacgtgcttagtcatatacctaaactcagggaacacacacacgcatgcttatggactcacacacactcacactcttacccacactcattctagccacactcacactcatatatactcaccaatacgctcacactcacacatatccttacacacccacactctcacatacccttacacacccacacacccttacacactcacactcacggtagccacactcatgtataaccaatatgctcacacatgtacccttacacacccacactcatactagccatactcacactcatatatactcaccaataagctcacacacatacccttacacacccacacaccgccttacacacacatactcgtacacgcccacacacacccttacacacccacacacatacccttacacagccacacacatacccttggacacccacactcactctagccactcatatatactcaccaataagctcacacacacatagccttacacacacatccttacccacatttacacactcatacccttacactgtcacactcacatgtacccttacacacccacactcacacacacccttacccacactcacacacacccttacacacccacactctcacacctttacacacccactcacacacatacccttacccccacacacccttatacacccacactcacactctagctacacccacactcatatatagtcaccaatatgctcacactctcgcactcacatgctgtcgtgctcgctcacataccgttgcacactcacatgctctcacacactctcacggtgaaatctgtgcctgccaccacactcaggttgcgatgtgtgtttcacttttagctcctctaaggttttactcacctggctccaccaaactggattttaccatagtctatacttaaatactgttcatctcttcttctacacaaaagtattaagaatttacctgcctgcaagttattggaatatcctgggcaaaagcaaataaaactttcccttttcccttgtttgacaccccctcatcagtgacccccacgacacgaccccaccaccctatctggcttggcatgtgatgcttcaggaagggcacagggtttccacggctcctgttaccctcttaagcctcagaaaacattggcacaggcagagaggagagctgtcatctgagtctctctgtgggatcctgggctcttagggaaaggccagacagggaggggcgggagagatttctgtggcctccaagattcctgggaaggcgaagtctggatttccttggagaggaaggagggcttaggccagccacataattagggtgcagtagacaaacagaaatcatttcttttggtccctcatctgcctcaaggctgtgtttgctccacatggccgcacaggcacttgcgtctgtgccctttggggctggcagagatggaggagaaagccttaagcaccatctctcctgattagcgctccacgcagcttctcttcacagcccctcccacacactgtgtcccactactcagacacatgggccgtgggcacagagggaaagggaccttgggaagaatagggagccaagccactcttcaccctcccaggtgtcgcccatagtggggcacatggggacacggtggccactcaccccctgccactgagtcccacagtgcagctgggcctgtggtcagatgccacagggacaccatagcacccgtagagtgtgtcatttccttggtgcacgagggccggatgatgtccccagaggctcactggcttcccacagcacagagggacctggcaccgctaccctaagatggaattgttaaaactacctccatttttatttttaaaagtatgatgtcaatgcataaaataaaaattgctttctgtcagatgcttctttattcaagcccctaaagaaatgttttcttgcctaagacagctcatattaaaatgtctaaagcccaagagaagtctaataaatttcagctttatgactttgtttactctgggtgtagaaaaagaattcttttatacgtagcctagtttccagaacttccagggtcaaaagttaacaaatttggggaaaacagaagagaaaagatagcatacagtattctgttttcctattaaaatgaggaaaacaaaggagtcatcagaactataatttacgggaaagtgtgcagacatccatctgcttttattgaaaaaataccctgcagatgttgggcctaattatgaatcctccattttcttgatgaaaaactttagtggcatctcaatctctgatcggtaaactgggtgtcgtagcacttacaaaatagaattatttcattgatctttagccatctattatttttttgtagatgagagagcattcagcatgaaggctgtttctatctgaatactaaatgttggtttcattcccacaggttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacgattatctgcctgcacttaatacagatggagaggaagtatgaaaataggaaacaaggccgggcgcggtggctcatgcctgtaatcccagcacttcgggaggccgaggcaggcggatcacgagattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgtt

SEQ ID NO: 23283 - DNA, 3646 bp, Homo sapiens
  ENST00000517432
tcaagatgcttttgtgtgtattatgggattgtatttatggccttgtccctgcattgtggatgtcaagggccagttgccacgtgcttagtcatatacctaaactcagggaacacacacacgcatgcttatggactcacacacactcacactcttacccacactcattctagccacactcacactcatatatactcaccaatacgctcacactcacacatatccttacacacccacactctcacatacccttacacacccacacacccttacacactcacactcacggtagccacactcatgtataaccaatatgctcacacatgtacccttacacacccacactcatactagccatactcacactcatatatactcaccaataagctcacacacatacccttacacacccacacaccgccttacacacacatactcgtacacgcccacacacacccttacacacccacacacatacccttacacagccacacacatacccttggacacccacactcactctagccactcatatatactcaccaataagctcacacacacatagccttacacacacatccttacccacatttacacactcatacccttacactgtcacactcacatgtacccttacacacccacactcacacacacccttacccacactcacacacacccttacacacccacactctcacacctttacacacccactcacacacatacccttacccccacacacccttatacacccacactcacactctagctacacccacactcatatatagtcaccaatatgctcacactctcgcactcacatgctgtcgtgctcgctcacataccgttgcacactcacatgctctcacacactctcacggtgaaatctgtgcctgccaccacactcaggttgcgatgtgtgtttcacttttagctcctctaaggttttactcacctggctccaccaaactggattttaccatagtctatacttaaatactgttcatctcttcttctacacaaaagtattaagaatttacctgcctgcaagttattggaatatcctgggcaaaagcaaataaaactttcccttttcccttgtttgacaccccctcatcagtgacccccacgacacgaccccaccaccctatctggcttggcatgtgatgcttcaggaagggcacagggtttccacggctcctgttaccctcttaagcctcagaaaacattggcacaggcagagaggagagctgtcatctgagtctctctgtgggatcctgggctcttagggaaaggccagacagggaggggcgggagagatttctgtggcctccaagattcctgggaaggcgaagtctggatttccttggagaggaaggagggcttaggccagccacataattagggtgcagtagacaaacagaaatcatttcttttggtccctcatctgcctcaaggctgtgtttgctccacatggccgcacaggcacttgcgtctgtgccctttggggctggcagagatggaggagaaagccttaagcaccatctctcctgattagcgctccacgcagcttctcttcacagcccctcccacacactgtgtcccactactcagacacatgggccgtgggcacagagggaaagggaccttgggaagaatagggagccaagccactcttcaccctcccaggtgtcgcccatagtggggcacatggggacacggtggccactcaccccctgccactgagtcccacagtgcagctgggcctgtggtcagatgccacagggacaccatagcacccgtagagtgtgtcatttccttggtgcacgagggccggatgatgtccccagaggctcactggcttcccacagcacagagggacctggcaccgctaccctaagatggaattgttaaaactacctccatttttatttttaaaagtatgatgtcaatgcataaaataaaaattgctttctgtcagatgcttctttattcaagcccctaaagaaatgttttcttgcctaagacagctcatattaaaatgtctaaagcccaagagaagtctaataaatttcagctttatgactttgtttactctgggtgtagaaaaagaattcttttatacgtagcctagtttccagaacttccagggtcaaaagttaacaaatttggggaaaacagaagagaaaagatagcatacagtattctgttttcctattaaaatgaggaaaacaaaggagtcatcagaactataatttacgggaaagtgtgcagacatccatctgcttttattgaaaaaataccctgcagatgttgggcctaattatgaatcctccattttcttgatgaaaaactttagtggcatctcaatctctgatcggtaaactgggtgtcgtagcacttacaaaatagaattatttcattgatctttagccatctattatttttttgtagatgagagagcattcagcatgaaggctgtttctatctgaatactaaatgttggtttcattcccacaggttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaatt

SEQ ID NO: 23284 - DNA, 2883 bp, Homo sapiens
  ENST00000422910
ctctcgcactcacatgctgtcgtgctcgctcacataccgttgcacactcacatgctctcacacactctcacggtgaaatctgtgcctgccaccacactcaggttgcgatgtgtgtttcacttttagctcctctaaggttttactcacctggctccaccaaactggattttaccatagtctatacttaaatactgttcatctcttcttctacacaaaagtattaagaatttacctgcctgcaagttattggaatatcctgggcaaaagcaaataaaactttcccttttcccttgtttgacaccccctcatcagtgacccccacgacacgaccccaccaccctatctggcttggcatgtgatgcttcaggaagggcacagggtttccacggctcctgttaccctcttaagcctcagaaaacattggcacaggcagagaggagagctgtcatctgagtctctctgtgggatcctgggctcttagggaaaggccagacagggaggggcgggagagatttctgtggcctccaagattcctgggaaggcgaagtctggatttccttggagaggaaggagggcttaggccagccacataattagggtgcagtagacaaacagaaatcatttcttttggtccctcatctgcctcaaggctgtgtttgctccacatggccgcacaggcacttgcgtctgtgccctttggggctggcagagatggaggagaaagccttaagcaccatctctcctgattagcgctccacgcagcttctcttcacagcccctcccacacactgtgtcccactactcagacacatgggccgtgggcacagagggaaagggaccttgggaagaatagggagccaagccactcttcaccctcccaggtgtcgcccatagtggggcacatggggacacggtggccactcaccccctgccactgagtcccacagtgcagctgggcctgtggtcagatgccacagggacaccatagcacccgtagagtgtgtcatttccttggtgcacgagggccggatgatgtccccagaggctcactggcttcccacagcacagagggacctggcaccgctaccctaagatggaattgttaaaactacctccatttttatttttaaaagtatgatgtcaatgcataaaataaaaattgctttctgtcagatgcttctttattcaagcccctaaagaaatgttttcttgcctaagacagctcatattaaaatgtctaaagcccaagagaagtctaataaatttcagctttatgactttgtttactctgggtgtagaaaaagaattcttttatacgtagcctagtttccagaacttccagggtcaaaagttaacaaatttggggaaaacagaagagaaaagatagcatacagtattctgttttcctattaaaatgaggaaaacaaaggagtcatcagaactataatttacgggaaagtgtgcagacatccatctgcttttattgaaaaaataccctgcagatgttgggcctaattatgaatcctccattttcttgatgaaaaactttagtggcatctcaatctctgatcggtaaactgggtgtcgtagcacttacaaaatagaattatttcattgatctttagccatctattatttttttgtagatgagagagcattcagcatgaaggctgtttctatctgaatactaaatgttggtttcattcccacaggttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaatt

SEQ ID NO: 23285 - DNA, 6377 bp, Homo sapiens
  ENST00000262096
cgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaggatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgatcacctacattatctgtctataagaaactgcctttgcactgacaatgtaaattattttaagcataaattttcctaatagtttattagagctactaatggcaaaattcatgtcttcaatgtggccataacataggtcttgggaggggtggtgagaaaataaggtatttactttgtagtagttaagtgattctgaggacaattagaaacagactataaaactcaactacactgtaatcaatagacaactattggaaatatggcatatgttgacaaacacttaactagggaaatcaaagatataaatcatgtttataaaaaattaggcacgcaatcatgtgattcatgcttcaagaaaatatatgaaaaaagtgttactccattatgttataaactagcagattttccctattttgaaatgcatgtaaacgggctcggctgattctgaaattgtactgtatcatttggtatttacttatatggtcaaatacttgtttgtaaaagtgatggttctgatacctttgatcaaacatagatacaaacctcagaaaatggtaaatgcaaagcagtttacgttgtaaatcatgatggtgtcctccagcacaaccatcccacccacacacctagactacagattctgatctgtgaatattttcaccaaagtgacatttaaacaagtggatttttcacaaataacacgtgtttaatatctttctgcagaaacgtgttcttctaaagcagaaaaccacgtggcttaatcccaaatgttttacacttcttttccacatacttagccagttcagcaccgatttcctcttatatgtggaaggagactatgttacatacctgaagtattactcttttacaaagataccattagaattttctcactgtcttggtaaaaattcctagattctactttttattgcaagtgttagcaatatgatcttgtaacgccatgaaaagcattaagtagaagccaacattaacctagattttacaactgagcaatctgttccccaccagatttcctttagaatttattaccaaaggatcttattttgttacagaacacaggaaattgttaaaccttataatgttgcaaaccatgcattttccttttctcttttccataagatttttttattgtagtagtgccctggcttgtaaacagtggacatcactgaaaggatgaaatcaagtaggcttgtttcaaagagactcctgtgaatcaactatgaatatgaagtatctcccagaacaatgttgagtgtttcaggagactctgaaacagggcacccattttttttttccttcctcaaaatagtctccttgaaatgtgagcaaagaactatgatgatgcagtccaggtatctaatagctcaatcaccaacaccgctgagaattgttcttataccagcaaaaagttcaaatacaataacctgggcaatgccaacagaagacacttttaatcatttgcagacctttcttgttgcaggaaagtgagggcaaaaacaaactggtgaaaaatgttcaaaaatagatctttttgatgttcatagccagtattcagtatttctgtattgtttacaattgggggaaaatgtctgttaaggctaatcatctgagtgatttgagtagcaattaaaccaaagggaaacttttaataagttattttaagccctggtttatggctagttcccttttgctcaggaaaaatagtactactttatggtttatgaaaacctatgatttatgttgcatcttccggggaaggtttaacagtacaaggagctgaatcctacctgaaattattaatgcttaatatattgcttctgtttgattgataaaggtgcttaatcaattgaaaaaaaaacgcataatgcttcaaggtaaaattccgttgattctgaatttaaaaagatactacagaatgcgtcagttctcctgttgtatttttctcagttatgagagcaaggctattttgtcagtttagattttgtgtctttttctgtcagtatgtatggctccctaattgaaaacatcttaaatgaactaatcaaacactta

SEQ ID NO: 23286 - DNA, 167 bp, Homo sapiens
  ENST00000523132
atttttgaggacatgtgcaacacactaaaccataatttaggtgtttgaacagtagggagagaaaaaaagaggtgatcgtctgaggtttttacatccagagagcgaagtggctccagtccgagttcgaggttcctgaattgtgtccatggaaaacactggcgaacaag

SEQ ID NO: 23287 - DNA, 487 bp, Homo sapiens
  ENST00000522184
aaacgtctcactcctagacatgtgagttggcttcctggccaatggaaaaggataaacaatgaggcaggtaaaaagagcttttggggagcactgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttct

SEQ ID NO: 23288 - DNA, 334 bp, Homo sapiens
  ENST00000517334
tgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaaggtacttctttgttaaaattttcaggctttaaactaatgaaaataatacagcaaaagatagtttcaggaaaagcctctagttccataggcttgtaattctgtgtaggaactcttatttttaaaaaata

SEQ ID NO: 23289 - DNA, 3778 bp, Homo sapiens
  ENST00000330212
ggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaa

SEQ ID NO: 23290 - DNA, 2055 bp, Homo sapiens
  ENST00000498275
aggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcgttggaggttaagcagagagagagaggcgtggacctatttacgagattatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccactt

SEQ ID NO: 23291 - DNA, 3466 bp, Homo sapiens
  ENST00000478793
gactcctgccgtcacgcccggggctccgcgtagcagagatcgggagacgcgtctgtgcctccggggaagccgacccatctcccctccgcctctttggctgcagttgcacctccggccagagggcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggtaaggtgctagcacacttgtgactgtggctggaagaggagaacagacactcctgtggggatgctttactctcttttctggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaagg

SEQ ID NO: 23292 - DNA, 740 bp, Homo sapiens
  ENST00000491556
ggctgtcgccataggaacggctggtgcccagacggcgcctgcccaggctgggaaggggcggtgaaggcagctcagacctccaagaaccctggagccccctgtgtggccaggcggagccacagaagcctgatgaaaacgggaccccctccccctctctcttctcatttttgattgctcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 23293 - DNA, 5059 bp, Homo sapiens
  ENST00000638807
agcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggccagtacaataggggcttcctgcggaactggcaccagttctccaccctgggcacacgtgcattccaccaccctgccgaggacattgtctgaagtgccttctatgtggctctctgagggatgatggctcctccttccgtctcccttccattttacacttcagtgtccatttctatccccagtttcttaaaggcattatagggccatgctcaggtttagagactggagtgggaagaagttaatttttctgacgccacaacttaagagacttttatactgaggcagtaaaagtagagccattcctttccagtcacctttttaattgactcagttgcctgaacttgagaaggatgtggattgctaatgcacaaattgatagaagcaattcccatccattagtatggaggaaagagtgttggattaggatagtttctagtccctctttcgattcttaatagccatgtgacccctagctgagtcactttcccaagtctcagggtcatctgcaaagtggggtactgatgcctgccctggctacctcacagagccgtcatgagggtcacgtgagggaagatggatgtggaaagcactaaaaaacaactcaagagccatggaaatacaaagtattaggaaaatattatgatggaagaaaaacgtttatagtctagaatattgaagccaatattattagggtaatcagttttcagcatataccttgttgtacagttatgagaatttctccttcttattagacatgaactactcaaacagagaagatgaccagatggattgatgctaagttgtctcatcttgaaaagacagttgacaacagttataaagataattattgctagtgtaatgtagtgtggccatgagtttaggtgatgagttcttctatttatattttataaattctgcttgggtttcttataaataactccaacaggcattcatgtgtttttcctcttcccatgtttcaccaggtaaggtgctagcacacttgtgactgtggctggaagaggagaacagacactcctgtggggatgctttactctcttttctggtaggaaggctgagtaacatcacgggctcgattattttcttcatgtatttcaaatgctgtcagttatagcactaaattgtgaaaatcagccttctggcattcacattattctggtatgaactttgaggagttgagtgacatcttcccacttaacttgcacattaattctcaattacccctccctaaataacagtatctcactaagagagaagaaacagggtatatgtggtttccactattaatggattactgttcttccctggctcttccgacaataacaagttgtttctttaatcatatcttaaaaccgaaaatgtataaaagattaaatatttatgtacaatgggttgttctactatagaattaagatgagggaatttcagatgaggaaaatacccttttgaaatgttagttttgaacatgtactgttgtgcaatcccaaagataattcatgactccttaaatttgccttggcttatagcttaatatagggaaaatattgccagcgttttcagtcattctgtgcatgctgctttaagcaagagatttatatttgttgagaggaaatattgctacttcctgcacttccaccctctgcagccagcaccgtccctactgttgccattaattggagctgtccttaagatggtcaccatattcttattcaggctgttgtcattttccccagagatggtttgtttaacgaatgataggctctgtgcctggggatgttagcagactctggggtttgtacagtgatgccttctccctggcccagagctgaatattcatctagaattaaagttggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaagg

SEQ ID NO: 23294 - DNA, 5280 bp, Homo sapiens
  ENST00000488129
accctgctctgtgcaggcgattcacagcacctcatctttttggttaggtccttggatttaatagtctttgaggtcccttcagcttttacaaatgaagattctgaatgaacttatttctaactaactcttaatttgcgaatgttggaaaatcatcaaatggcagaggctaactggcagcctgtctcattagtgagcctgagaggagcttccctaccttgtgtgattgtgttgggctttaggagggtgaatttggaatgtctcggtgttcctacatccagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggccagtacaataggggcttcctgcggaactggcaccagttctccaccctgggcacacgtgcattccaccaccctgccgaggacattgtctgaagtgccttctatgtggctctctgagggatgatggctcctccttccgtctcccttccattttacacttcagtgtccatttctatccccagtttcttaaaggcattatagggccatgctcaggtttagagactggagtgggaagaagttaatttttctgacgccacaacttaagagacttttatactgaggcagtaaaagtagagccattcctttccagtcacctttttaattgactcagttgcctgaacttgagaaggatgtggattgctaatgcacaaattgatagaagcaattcccatccattagtatggaggaaagagtgttggattaggatagtttctagtccctctttcgattcttaatagccatgtgacccctagctgagtcactttcccaagtctcagggtcatctgcaaagtggggtactgatgcctgccctggctacctcacagagccgtcatgagggtcacgtgagggaagatggatgtggaaagcactaaaaaacaactcaagagccatggaaatacaaagtattaggaaaatattatgatggaagaaaaacgtttatagtctagaatattgaagccaatattattagggtaatcagttttcagcatataccttgttgtacagttatgagaatttctccttcttattagacatgaactactcaaacagagaagatgaccagatggattgatgctaagttgtctcatcttgaaaagacagttgacaacagttataaagataattattgctagtgtaatgtagtgtggccatgagtttaggtgatgagttcttctatttatattttataaattctgcttgggtttcttataaataactccaacaggcattcatgtgtttttcctcttcccatgtttcaccaggtaaggtgctagcacacttgtgactgtggctggaagaggagaacagacactcctgtggggatgctttactctcttttctggtaggaaggctgagtaacatcacgggctcgattattttcttcatgtatttcaaatgctgtcagttatagcactaaattgtgaaaatcagccttctggcattcacattattctggtatgaactttgaggagttgagtgacatcttcccacttaacttgcacattaattctcaattacccctccctaaataacagtatctcactaagagagaagaaacagggtatatgtggtttccactattaatggattactgttcttccctggctcttccgacaataacaagttgtttctttaatcatatcttaaaaccgaaaatgtataaaagattaaatatttatgtacaatgggttgttctactatagaattaagatgagggaatttcagatgaggaaaatacccttttgaaatgttagttttgaacatgtactgttgtgcaatcccaaagataattcatgactccttaaatttgccttggcttatagcttaatatagggaaaatattgccagcgttttcagtcattctgtgcatgctgctttaagcaagagatttatatttgttgagaggaaatattgctacttcctgcacttccaccctctgcagccagcaccgtccctactgttgccattaattggagctgtccttaagatggtcaccatattcttattcaggctgttgtcattttccccagagatggtttgtttaacgaatgataggctctgtgcctggggatgttagcagactctggggtttgtacagtgatgccttctccctggcccagagctgaatattcatctagaattaaagttggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaatagctggtgtttcttggagtgtctcctgaagtcttctgatttctgaaaaccctgcattatacctgtgctgcctctgtggctccctcaatgtctctatcctgtggccctgtccctagccctaaactgttatgttcccggtggcaatttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtag

SEQ ID NO: 23295 - DNA, 317 bp, Homo sapiens
  ENST00000496083
tacaatgtgactgagcgggaagtccagcaggccctccgacagaagactgggcgccggctcctctgcgggctcatcgtggacacagacttgtcttactcaaggaccaagtatctgattgctgatatagctcgtggtaccttccaggtacctggaagtctggaagaatttcaactaccttcctacgaagttgctgtcgcctttcttcttttactctttcctctttcataaattttacaaacttcttccatgtccgaagggtgatccagaggatcctcctttaagaataaagaaggaaaaaagtgaaatgttgagaaaaa

SEQ ID NO: 23296 - DNA, 1414 bp, Homo sapiens
  ENST00000639389
atgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacagtttatgactcacatgcctccagagaagaagagctaagtgcttggttctggagcggaacatgatcatttttgcctttcggattcctgtggtattgtcccctgtggaggattcaacaggtcagctaattgtctgtaaggaatgggatgttattcagcagaatttcagggagaggaagagatgcagagtctcataagaaaaaagacagagtaaaaaaacagatgtctctttccagagtgtcaggaggggcaggcccacctgggaagtatgatgtatgaggatgcattgtgagaaagaggtggacctaagatagcaaaacagtgagggagctatatggtggagaaatgggagagacacgattccagcaggggaaattttagggagaaacagagaagcctaaatattgttcagaagctttctgtgtggtacatgttacaaaacccctgtttcacctctttactcatagtaaataggttcattattcttctggaccctgtggccagactggagtttccctgaacatgacactacacagtgaccagtctggggaggaggggttacacatcactgaagtagttagataaatagaaacaatatataaggaaagacaatattagtagataaggccccaatccccaaccccatcagtttctgcctgcagcctgtctgaaccctcactattgcctccaagagtgtcattgtgaaaaaatatagagctttcagagaaatgctgggctcagaagtagagaaaagaagacattttgaaaaccataataaaaggtttttaaaaagtaaatatagtacagaggattagcttgtgttcaaaagggcagaaggattagtgtgccatttggtattcctctccttaaaaattttctttcttagaaagaaggaaaggccaggaccggtggctcacacctgtaaccccagcacactgggaggctgaggcaggtagactgcctgaacccaggagttcaaggccagcctgggtaacacggcaaaaccctgcctctacaaaaaatgaaaaaattagctgggtgtggtggcgcacgtctgtagtcccagccactcaggatcctttggtgggaggatcacctgagcctgggaaggtcaaggctgtagtggagttgtagttatgttcaggccaccaccatgctccaacctgggcaacagagtgagaccccgtgtcaagaaagaaagagagaaagagagagggagggagagaggaaggaaaggaagaaggaaggaaggaaggaaggaaggaag

SEQ ID NO: 23297 - DNA, 9339 bp, Homo sapiens
  ENST00000638087
ctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcattgctgggactgagggctgcaaaagcagcccgccggttcttgtgagttattttaacatttgtgttggtcttgcctgtgtcactttgaaatcttctgtaattatgacactatgaagacatctcaatagtagtattaatggcccagaagatatggcttttcctcattttctgcttaaaagattaggatataaatggccttagcacatgacggttgacatagaagaaagagtgaaaattcagatggagcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23298 - DNA, 9140 bp, Homo sapiens
  ENST00000638007
actctaatctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcattgctgggactgagggctgcaaaagcagcccgccggttctttggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23299 - DNA, 8984 bp, Homo sapiens
  ENST00000636413
gggttaacagttcttggcaatcctgtgtgtgcgtaacggctgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga
